US008852927B2

(12) United States Patent
Szalay et al.

(10) Patent No.: US 8,852,927 B2
(45) Date of Patent: *Oct. 7, 2014

(54) MICROORGANISMS FOR IMAGING AND/OR TREATMENT OF TUMORS

(75) Inventors: Aladar A. Szalay, Highland, CA (US); Nanhai Chen, San Diego, CA (US); Yong A. Yu, San Diego, CA (US); Qian Zhang, San Diego, CA (US)

(73) Assignee: Genelux Corporation, San Diego, CA (US)

( * ) Notice: Subject to any disclaimer, the term of this patent is extended or adjusted under 35 U.S.C. 154(b) by 115 days.

This patent is subject to a terminal disclaimer.

(21) Appl. No.: 12/660,314

(22) Filed: Feb. 23, 2010

(65) Prior Publication Data
US 2010/0233078 A1 Sep. 16, 2010

Related U.S. Application Data

(62) Division of application No. 12/157,960, filed on Jun. 13, 2008, now abandoned.

(60) Provisional application No. 60/934,768, filed on Jun. 15, 2007.

(51) Int. Cl.
*C12N 15/39* (2006.01)
*G01N 33/574* (2006.01)
*C12N 7/00* (2006.01)
*A61K 35/76* (2006.01)
*C07K 14/705* (2006.01)
*A61K 38/00* (2006.01)

(52) U.S. Cl.
CPC ............ *C07K 14/705* (2013.01); *G01N 33/574* (2013.01); *A61K 38/00* (2013.01); *C12N 7/00* (2013.01); *A61K 35/76* (2013.01); *C12N 2710/24143* (2013.01); *C12N 2710/24132* (2013.01)
USPC ..................... 435/320.1; 424/93.21

(58) Field of Classification Search
CPC ........... A61K 2039/5256; A61K 41/00; A61K 49/0047; A61K 51/1045
See application file for complete search history.

(56) References Cited

U.S. PATENT DOCUMENTS

| | | | |
|---|---|---|---|
| 4,216,226 A | 8/1980 | Fukuyasu et al. | 424/311 |
| 4,315,914 A | 2/1982 | Arakawa et al. | 424/89 |
| 4,603,112 A | 7/1986 | Paoletti et al. | 435/235.1 |
| 4,722,848 A | 2/1988 | Paoletti et al. | 424/199.1 |
| 4,769,330 A | 9/1988 | Paoletti et al. | 435/436 |
| 4,912,199 A | 3/1990 | Lown et al. | 530/331 |
| 4,980,285 A | 12/1990 | Sano et al. | 435/108 |
| 5,102,651 A | 4/1992 | Wilbur et al. | 424/1.1 |
| 5,110,587 A | 5/1992 | Paoletti et al. | 435/235.1 |
| 5,174,993 A | 12/1992 | Paoletti | 424/199.1 |
| 5,221,623 A | 6/1993 | Legocki et al. | 435/252.3 |
| 5,277,893 A | 1/1994 | Rhodes | 424/1.49 |
| 5,364,773 A | 11/1994 | Paoletti et al. | 435/69.1 |
| 5,368,855 A | 11/1994 | Boyle et al. | 435/320.1 |
| 5,631,150 A | 5/1997 | Harkki et al. | 435/105 |
| 5,707,928 A | 1/1998 | Baker | 505/139 |
| 5,710,137 A | 1/1998 | Fisher | 514/44 |
| 5,719,054 A | 2/1998 | Boursnell et al. | 435/320.1 |
| 5,759,828 A | 6/1998 | Tal et al. | 435/69.1 |
| 5,762,938 A | 6/1998 | Paoletti et al. | 424/199.1 |
| 5,866,131 A | 2/1999 | Ramshaw et al. | 424/186.1 |
| 5,888,783 A | 3/1999 | Tomita et al. | 435/115 |
| 5,919,670 A | 7/1999 | Okamoto et al. | 435/106 |
| 5,922,576 A | 7/1999 | He et al. | 435/91.41 |
| 6,190,657 B1 | 2/2001 | Pawelek et al. | 424/93.1 |
| 6,232,523 B1 | 5/2001 | Tan et al. | 800/10 |
| 6,235,967 B1 | 5/2001 | Tan et al. | 800/10 |
| 6,235,968 B1 | 5/2001 | Tan et al. | 800/10 |
| 6,251,384 B1 | 6/2001 | Tan et al. | 424/93.21 |
| 6,265,189 B1 | 7/2001 | Paoletti et al. | 435/70.1 |
| 6,319,703 B1 | 11/2001 | Speck | 435/235.1 |
| 6,391,579 B1 | 5/2002 | Carrasco et al. | 435/393 |
| 6,428,968 B1 | 8/2002 | Molnar-Kimber et al. | 435/7.23 |
| 6,429,001 B1 | 8/2002 | Hardy | 435/235.1 |
| 6,455,673 B1 | 9/2002 | Collier | 530/350 |
| 6,503,703 B1 | 1/2003 | Palese et al. | 435/5 |
| 6,537,594 B1 | 3/2003 | Paoletti et al. | 424/93.2 |
| 6,548,068 B1 | 4/2003 | Schlom et al. | 424/199.1 |
| 6,573,090 B1 | 6/2003 | Breakefield et al. | 435/320.1 |
| 6,586,411 B1 | 7/2003 | Russell et al. | 514/44 |
| 6,759,038 B2 | 7/2004 | Tan et al. | 424/93.21 |
| 6,800,288 B2 | 10/2004 | Ferko et al. | 424/199.1 |

(Continued)

FOREIGN PATENT DOCUMENTS

EP 0 037 441 10/1981
EP 0 861 093 9/1998

(Continued)

OTHER PUBLICATIONS

Yoon et al. Human Gene Therapy 2006, vol. 17, pp. 379-390.*
Afanasieva et al. Gene Therapy 2003, vol. 10, pp. 1850-1859.*
Genetics Home reference published on Jun. 2011 for SLC6A8 (pp. 1-4).*
Genetics Home reference published on Jun. 2011 for SLC5 (pp. 1-4).*
Mackenzie et al. Antioxidates & Redox Signaling, 2008, vol. 10, No. 6, pp. 997-1030.*
Eide D, Pfluger Arch- Eur. J. Physiol, 2004, vol. 447, pp. 790-800.*
Afanasieva et al., "Single-chain antibody and its derivatives directed against vascular endothelial growth factor: application for antiangiogenic gene therapy," Gene Ther. 10:1850-1859 (2003).

(Continued)

*Primary Examiner* — Bao Li
(74) *Attorney, Agent, or Firm* — McKenna Long & Aldridge LLP; Stephanie Seidman

(57) ABSTRACT

Modified viruses encoding transporter proteins and methods for preparing the modified viruses are provided. Vaccines that contain the viruses are provided. The viruses also can be used in diagnostic methods, such detection and imaging of tumors. The viruses also can be used in methods of treatment of diseases, such as proliferative and inflammatory disorders, including as anti-tumor agents.

36 Claims, No Drawings

(56) References Cited

U.S. PATENT DOCUMENTS

| | | | | |
|---|---|---|---|---|
| 6,803,199 | B2 | 10/2004 | Carrasco et al. | 435/6 |
| 7,015,027 | B1 | 3/2006 | Redshaw | 435/252.3 |
| 7,045,313 | B1 | 5/2006 | Moss et al. | 435/69.1 |
| 7,247,296 | B2 | 7/2007 | Redshaw | 424/93.1 |
| 7,309,576 | B2 | 12/2007 | O'Dowd et al. | 435/7.1 |
| 7,320,863 | B2 | 1/2008 | Carrasco et al. | 435/6 |
| 7,588,767 | B2 | 9/2009 | Szalay et al. | 424/199.1 |
| 7,588,771 | B2 | 9/2009 | Szalay et al. | 424/232.1 |
| 7,645,865 | B2 | 1/2010 | Russell et al. | 536/23.1 |
| 7,662,398 | B2 | 2/2010 | Szalay et al. | 424/232.1 |
| 7,754,221 | B2 | 7/2010 | Szalay et al. | 424/199.1 |
| 7,763,420 | B2 | 7/2010 | Stritzker et al. | 435/4 |
| 7,820,184 | B2 | 10/2010 | Stritzker et al. | 424/241.1 |
| 7,982,022 | B2 | 7/2011 | Russell et al. | 536/23.1 |
| 8,021,662 | B2 | 9/2011 | Szalay et al. | 424/138.1 |
| 8,052,968 | B2 * | 11/2011 | Chen et al. | 424/93.21 |
| 8,066,984 | B2 * | 11/2011 | Szalay et al. | 424/93.21 |
| 8,137,904 | B2 | 3/2012 | Szalay et al. | 435/4 |
| 8,221,769 | B2 | 7/2012 | Szalay et al. | 424/232.1 |
| 8,323,959 | B2 | 12/2012 | Szalay et al. | 435/320.1 |
| 8,357,486 | B2 | 1/2013 | Stritzker et al. | 435/4 |
| 8,568,707 | B2 | 10/2013 | Szalay et al. | 424/9.3 |
| 8,586,022 | B2 | 11/2013 | Szalay et al. | 424/93.2 |
| 8,642,257 | B2 | 2/2014 | Szalay et al. | 435/5 |
| 2003/0009015 | A1 | 1/2003 | Ulrich et al. | 536/23.1 |
| 2003/0031681 | A1 | 2/2003 | McCart et al. | 424/186.1 |
| 2003/0044384 | A1 | 3/2003 | Roberts et al. | 424/93.2 |
| 2003/0059400 | A1 | 3/2003 | Szalay | 424/93.2 |
| 2003/0086906 | A1 | 5/2003 | Mastrangelo et al. | 424/93.2 |
| 2003/0165465 | A1 | 9/2003 | Roberts et al. | 424/93.2 |
| 2003/0198627 | A1 | 10/2003 | Arts et al. | 424/93.2 |
| 2003/0228261 | A1 | 12/2003 | Szalay et al. | 424/9.34 |
| 2004/0115703 | A1 | 6/2004 | Schwartz et al. | 424/9.2 |
| 2004/0143861 | A1 | 7/2004 | Hadlaczky et al. | 800/14 |
| 2004/0213741 | A1 | 10/2004 | Szalay et al. | 424/9.6 |
| 2004/0234455 | A1 | 11/2004 | Szalay et al. | 424/9.6 |
| 2005/0031643 | A1 | 2/2005 | Szalay et al. | 424/199.1 |
| 2005/0069491 | A1 | 3/2005 | Yu et al. | 424/1.11 |
| 2005/0249670 | A1 | 11/2005 | Szalay et al. | 424/9.32 |
| 2005/0281782 | A1 | 12/2005 | Kaufman et al. | 424/93.2 |
| 2006/0004191 | A1 | 1/2006 | Jhiang et al. | 536/23.5 |
| 2006/0051370 | A1 | 3/2006 | Szalay et al. | 424/199.1 |
| 2006/0099224 | A1 | 5/2006 | Kirn | 424/199.1 |
| 2006/0147420 | A1 | 7/2006 | Fueyo et al. | 424/93.2 |
| 2006/0193832 | A1 | 8/2006 | Domann et al. | 424/93.2 |
| 2007/0025981 | A1 | 2/2007 | Szalay et al. | 424/130.1 |
| 2007/0065411 | A1 | 3/2007 | Kirn | 424/93.2 |
| 2007/0172455 | A1 | 7/2007 | Revel et al. | 424/85.2 |
| 2007/0202572 | A1 | 8/2007 | Szalay et al. | 435/69.1 |
| 2007/0212727 | A1 | 9/2007 | Szalay et al. | 435/6 |
| 2007/0280883 | A1 | 12/2007 | Rahman et al. | 424/11.81 |
| 2008/0193373 | A1 | 8/2008 | Stritzker et al. | 424/1.17 |
| 2008/0286237 | A1 | 11/2008 | Kirn | 424/93.2 |
| 2009/0004723 | A1 | 1/2009 | Kirn et al. | 435/236 |
| 2009/0053244 | A1 | 2/2009 | Chen et al. | 424/174.1 |
| 2009/0081639 | A1 | 3/2009 | Hill et al. | 435/5 |
| 2009/0098529 | A1 | 4/2009 | Chen et al. | 435/5 |
| 2009/0117034 | A1 | 5/2009 | Chen et al. | 424/1.17 |
| 2009/0117047 | A1 | 5/2009 | Szalay et al. | 424/9.3 |
| 2009/0117048 | A1 | 5/2009 | Szalay et al. | 424/9.3 |
| 2009/0117049 | A1 | 5/2009 | Szalay et al. | 424/9.3 |
| 2009/0123382 | A1 | 5/2009 | Szalay et al. | 424/9.6 |
| 2009/0136917 | A1 | 5/2009 | Szalay et al. | 435/5 |
| 2009/0155287 | A1 | 6/2009 | Chen et al. | 424/158.1 |
| 2009/0162288 | A1 | 6/2009 | Chen et al. | 424/9.3 |
| 2009/0175830 | A1 | 7/2009 | Fueyo et al. | 424/93.2 |
| 2009/0180955 | A1 | 7/2009 | Stritzker et al. | 424/1.73 |
| 2009/0180987 | A1 | 7/2009 | Stritzker et al. | 424/93.2 |
| 2009/0311664 | A1 | 12/2009 | Fong et al. | 435/5 |
| 2010/0008946 | A1 | 1/2010 | Szalay et al. | 424/199.1 |
| 2010/0062016 | A1 | 3/2010 | Szalay et al. | 424/199.1 |
| 2010/0080775 | A1 | 4/2010 | Perricaudet et al. | 435/6 |
| 2010/0196325 | A1 | 8/2010 | Szalay et al. | 424/93.6 |
| 2011/0044937 | A1 | 2/2011 | Bell et al. | 424/85.2 |
| 2011/0064650 | A1 | 3/2011 | Szalay | 424/1.11 |
| 2011/0293527 | A1 | 12/2011 | Chen et al. | 424/9.3 |
| 2011/0300176 | A1 | 12/2011 | Szalay | 424/199.1 |
| 2012/0020883 | A1 | 1/2012 | Stritzker et al. | |
| 2012/0052003 | A9 | 3/2012 | Szalay | 424/1.11 |
| 2012/0244068 | A1 | 9/2012 | Chen et al. | 424/1.11 |
| 2012/0276010 | A1 | 11/2012 | Szalay et al. | 424/9.1 |
| 2012/0308484 | A1 | 12/2012 | Szalay et al. | 424/9.3 |
| 2013/0129614 | A9 | 5/2013 | Szalay et al. | 424/1.11 |
| 2013/0130292 | A1 | 5/2013 | Szalay et al. | 435/18 |
| 2013/0273007 | A1 | 10/2013 | Szalay et al. | 424/93.2 |
| 2013/0280170 | A1 | 10/2013 | Szalay | 424/9.2 |
| 2014/0086976 | A1 | 3/2014 | Szalay et al. | 424/445 |

FOREIGN PATENT DOCUMENTS

| | | |
|---|---|---|
| EP | 1 281 767 | 2/2003 |
| EP | 1 526 185 | 4/2005 |
| JP | 3934673 | 3/2007 |
| WF | WO 00/73479 | 12/2000 |
| WO | WO 91/14775 | 10/1991 |
| WO | WO 92/22327 | 12/1992 |
| WO | WO 93/01296 | 1/1993 |
| WO | WO 95/27494 | 10/1995 |
| WO | WO 97/32590 | 9/1997 |
| WO | WO 98/42855 | 7/1999 |
| WO | WO 01/14886 | 3/2001 |
| WO | WO 01/35970 | 5/2001 |
| WO | WO 01/48246 | 7/2001 |
| WO | WO 01/91789 | 5/2002 |
| WO | WO 03/006069 | 1/2003 |
| WO | WO 03/073919 | 9/2003 |
| WO | WO 04/000236 | 12/2003 |
| WO | WO 2005/047458 | 5/2005 |
| WO | WO 2005/049846 | 6/2005 |
| WO | WO 2007/075879 | 7/2007 |
| WO | WO 2008/021870 | 2/2008 |
| WO | WO 2008/043851 | 4/2008 |
| WO | WO 2008/156655 | 12/2008 |
| WO | WO 2009/054996 | 4/2009 |

OTHER PUBLICATIONS

Howard et al., "Molecular mimicry of the inflammation modulatory proteins (IMPs) of poxviruses: evasion of the inflammatory response to preserve viral habitat," J. Leukocyte Biol. 64:68-71 (1998).

Zhu et al., "A cellular protein binds vaccinia virus late promoters and activates transcription in vitro," J. Virol. 72(5):3893-3899 (1998).

Advani et al., "Oncolytic vaccinia virus encoding an anti-VEGF antibody improves the therapeutic efficacy of fractionated radiotherapy in lung tumor xenografts," Abstract, ASTRO 53rd Annual Meeting, Miami Beach, FL, Oct. 2-6, 2011 [2 pages].

Advani et al., "Radiotargeting systemically administered oncolytic vaccinia virus to preferentially replicate in radiated gliomas," Abstract, ASTRO 53rd Annual Meeting, Miami Beach, FL, Oct. 2-6, 2011 [1 page].

Gentschev et al., "Significant growth inhibition of canine mammary carcinoma xenografts following treatment with oncolytic vaccinia virus GLV-1h68," J. Oncol. 2010:1-10 (2010).

Haddad et al., "Insertion of the human sodium iodide symporter to facilitate deep tissue imaging does not alter oncolytic or replication capability of novel vaccinia virus," J. Translational Med. 9:36 (2011).

Examination Report, issued Jan. 24, 2011, in connection with European Patent Application Serial No. 08768418.9.

Hoffman et al., "Vaccinia virus GLV-1h237 carrying a Walker A motif mutation of mouse Cdc6 protein enhances human breast tumor therapy in mouse xenografts," Int. J. Oncol. 38(3):871-878 (2011) [Published online Jan. 18, 2011].

Seubert et al., "Enhanced tumor therapy using vaccinia virus strain GLV-1h68 in combination with a β-galactosidase-activatable prodrug seco-analog of duocarmycin SA," Cancer Gene Ther. 18:42-52 (2011).

Adonai et al., "Ex vivo cell labeling with $^{64}$Cu-pyruvaldehyde-bis($N^4$-methylthiosemicarbazone) for imaging cell trafficking in mice with positron-emission tomography," Proc. Natl. Acad. Sci. U.S.A. 99:3030-3035 (2002).

Adusumilli et al., "Imaging and therapy of malignant pleural mesothelioma using replication-competent herpes simplex viruses," J. Gene Med. 8(5):603-615 (2006).

(56) References Cited

OTHER PUBLICATIONS

Advisory Committee on Immunization Practices (ACIP), "Smallpox vaccination and adverse reactions: guidance for clinician," MMWR 52(RR-4):1-29 (2003).
Advisory Committee on Immunization Practices (ACIP), "Vaccinia (smallpox) vaccine: recommendations of the Advisory Committee on Immunization Practices (ACIP)," MMWR 50(RR-10):1-26 (2001).
Ahn et al., "Polarized expression of GABA transporters in Madin-Darby canine kidney cells and cultured hippocampal neurons," J. Biol. Chem. 271(12):6917-6924 (1996).
Akita et al., "Identification of oligopeptides binding to peritoneal tumors of gastric cancer," Cancer Sci. 97(10):1075-1081 (2006).
Alcami et al., "Vaccinia virus strains Lister, USSR and Evans express soluble and cell-surface tumour necrosis factor receptors," J. Gen. Virol. 80:949-959 (1999).
Al'tshtein et al., "Isolation of a recombinant vaccinia virus based on the LIVP strain inducing the suface antigen of the hepatitis B virus," Dokl. Akad. Nauk. SSSR 285(3):696-699 (1985) [Article in Russian].
Amato et al., "Luminous with promise," Chem. Eng. News. 84(49):69-73 (2006).
Antoine et al., "Characterization of the vaccinia MVA hemagglutinin gene locus and its evaluation as an insertion site for foreign genes," Gene 177:43-46 (1996).
Arakawa et al., "Clinical trial of attenuated vaccinia virus AS strain in the treatment of advanced adenocarcinoma. Report on two cases," J. Cancer Res. Clin. Oncol. 113(1):95-98 (1987).
ATCC Accession No. VR-1549, Retrieved from the Internet:<URL: atcc.org/ATCCAdvancedCatalogSearch/ProductDetails/tabid/452/Default.aspx?ATCCNum=VR-1549&Template=animalVirology, [retrieved on Apr. 28, 2010] [3 pages].
Ausubel et al., "Generation of recombinant vaccinia viruses," Unit 16.17 in Short Protocols in Molecular Biology 2$^{nd}$ edition: a compendium of Methods from Current Protocols in Molecular Biology, Green Publishing and John Wiley and Sons: New York, 15:16.71-16.82 (1992).
Barton et al., "GENIS: Gene expression of sodium iodide symporter for noninvasive imaging of gene therapy vectors and quantification of gene expression in vivo," Mol. Ther. 8:508-518 (2003).
Belas et al., "Bacterial bioluminescence: isolation and expression of the luciferase genes from *Vibrio harveyi*," Science 218:791-793 (1982).
Bell et al., "Getting oncolytic virus therapies off the ground," Cancer Cell 4:7-11 (2003).
Bergsland et al., "Shedding old paradigms: developing viruses to treat cancer," J. Clin. Oncol. 20(9):2220-2222 (2002).
Bernards et al., "Effective tumor immunotherapy directed against an oncogene-encoded product using a vaccinia virus vector," Proc. Natl. Acad. Sci. U.S.A. 84:6854-6858 (1987).
Beshara et al., "Pharmacokinetics and red cell utilization of iron(III) hydroxide-sucrose complex in anaemic patients: a study using positron emission tomography," Br. J. Haematol. 104:296-302 (1999).
Bevis, B. and B. Glick, "Rapidly maturing variants of the *Discosoma* red fluorescent protein (DsRed)," Nat. Biotechnol. 20(1):83-87 (2002).
Bianchi, C. and T. Bianchi, "Malignant mesothelioma: global incidence and relationship with asbestos," Ind. Health 45:379-387 (2007).
Blechacz et al., "Engineered measles virus as a novel oncolytic viral therapy system for hepatocellular carcinoma," Hepatology 44(6):1465-1477 (2006).
Blumenreich et al., "High-dose cisplatin in patients with advanced malignancies," Cancer 55(5):1118-1122 (1985).
Boelaert et al., "Sodium iodide symporter: a novel strategy to target breast, prostate, and other cancers?" Lancet 361:796-797 (2003).
Boland et al., "Adenovirus-mediated transfer of the thyroid sodium/iodide symporter gene into tumors for a targeted radiotherapy," Cancer Res. 60:3484-3492 (2000).
Bönisch et al., "The noradrenaline transporter of the neuronal plasma membrane," Ann. N.Y. Acad. Sci. 733:193-202 (1994).
Bönisch et al., "The norepinephrine transporter in physiology and disease," Handb. Exp. Pharmacol. 175:485-524 (2006).
Broder et al., "Recombinant vaccinia viruses," Mol. Biotechnol. 13:223:245 (1999).
Brown M., "Killer into cure—oncolytic viruses," Microbiol. Today 56:128-131 (2005).
Broyles, et al., "Antiviral activity of distamycin A against vaccinia virus is the result of inhibition of postreplicative mRNA synthesis," J. Virol. 78(4):2137-2141 (2004).
Buller et al., "Decreased virulence of recombinant vaccinia virus expression vectors is associated with a thymidine kinase-negative phenotype," Nature 317:813-815 (1985).
Buursma et al., "The human norepinephrine transporter in combination with $^{11}$C-m-hydroxyephedrine as a reporter gene/reporter probe for PET of gene therapy," J. Nucl. Med. 46(12):2068-2075 (2005).
Calonder et al., "Kinetic modeling of $^{52}$Fe/$^{52m}$Mn-citrate at the blood-brain barrier by positron emission tomography," J. Neurochem. 73:2047-2055 (1999).
Carlin et al., "Sodium-iodide symporter (NIS)-mediated accumulation of [$^{211}$At]astatide in NIS-transfected human cancer cells," Nucl. Med. Biol. 29:729-739 (2002).
Certified English translation of Al'tshtein [Altshteyn] et al., "Isolation of a recombinant vaccinia virus based on the LIVP strain inducing the surface antigen of the hepatitis B virus," Dokl. Akad. Nauk. SSSR. 285(3):696-699 (1985) [Article in Russian].
Certified English Translation of Chernos et al., "Verifying the safety, inoculability, reactogenicity and antigenic properties of a live recombinant smallpox-hepatitis B vaccine in an experiment on volunteers," Vopr. Virusol. (Moscow) 35:132-135 (1990) [Article in Russian].
Certified English translation of Timiriasova et al., "Analysis of reporter gene expression in various regions of the genome of the vaccinia virus," Mol. Biol. 27(2):2-11 (1993) [Article in Russian].
Chakrabarti et al., "Compact, synthetic, vaccinia virus early/late promoter for protein expression," BioTechniques 23(6):1094-1097 (1997).
Chakrabarti et al., "Vaccinia virus expression vector: coexpression of β-galactosidase provides visual screening of recombinant virus plaques," Mol. Cell Biol. 5:3403-3409 (1985).
Chamberlain et al., "Costimulation enhances the active immunotherapy effect of recombinant anticancer vaccines," Cancer Res. 56:2832-2836 (1996).
Chen, "Orthopedic applications of gene therapy," J. Orthop. Sci. 6:199-207 (2001).
Chen et al. "Evaluation of combined vaccinia virus-mediated antitumor gene therapy with p53, IL-2, and IL-12 in a glioma model," Cancer Gene Ther. 7(11):1437-1447 (2000).
Chen et al., "Real-time monitoring of vaccinia virus infection in cultured cells and in living mice using light-emitting proteins," Proceedings of the 14th International Symposium on Bioluminescence & Chemiluminescence: Chemistry, Biology and Applications, World Scientific: Singapore: 181-184 (2007).
Chen et al., "Low-dose vaccinia virus-mediated cytokine gene therapy of glioma," J. Immunother. 24(1):46-57 (2001).
Chernajovsky et al., "Fighting cancer with oncolytic viruses," BMJ 332(7534):170-172 (2006).
Chernos et al., "Verifying the safety, inoculability, reactogenicity and antigenic properties of a live recombinant smallpox-hepatitis B vaccine in an experiment on volunteers," Vopr. Virusol. (Moscow) 35:132-135 (1990) [article in the Russian language].
Chiocca, E., "Oncolytic virus," Nat. Rev. Cancer 2(12):938-950 (2002).
Cho et al., "In vivo imaging and radioiodine therapy following sodium iodide symporter gene transfer in animal model of intracerebral gliomas," Gene Ther. 9(17):1139-1145 (2002).
ClinicalTrials.gov, "Safety study of GL-ONC1, an oncolytic virus, in patients with advanced solid tumors," retrieved from the Internet:<URL: clinicaltrials.gov/ct2/show/NCT00794131?term=genelux&rank=1, [retrieved on Dec. 2, 2008] [4 pages].

(56) References Cited

OTHER PUBLICATIONS

Conry et al., "Phase I trial of a recombinant vaccinia virus encoding carcinoembryonic antigen in metastatic adenocarcinoma: comparison of intradermal versus subcutaneous administration," Clin. Cancer Res. 5:2330-2337 (1999).
Contag et al., "Photonic detection of bacterial pathogens in living hosts," Mol. Microbiol. 18:593-603 (1995).
Coupar et al., "A general method for the construction of recombinant vaccinia viruses expressing multiple foreign genes," Gene 68:1-10 (1988).
Davis et al., "Oncolytic virotherapy for cancer treatment: challenges and solutions," J. Gene Med. 7(11):1380-1389 (2005).
Davison et al., "New vaccinia virus recombination plasmids incorporating a synthetic late promoter for high level expression of foreign proteins," Nucleic Acids Res. 18:4285-4286 (1990).
Davison et al., "Structure of vaccinia virus early promoters," J. Mol. Biol. 210:749-769 (1989).
Dayem et al., "Comparison of expressed human and mouse sodium/iodide symporters reveals differences in transport properties and subcellular localization," J. Endocrinol. 197:95-109 (2008).
de Wet et al., "Firefly luciferase gene: structure and expression in mammalian cells," Mol. Cell. Biol. 7:725-737 (1987).
Distelmaier et al., "Functional importance of the C-terminus of the human norepinephrine transporter," J. Neurochem. 91:537-546 (2004).
Dobbelstein, M., "Viruses in therapy—royal road or dead end?" Virus Res. 92:219-221 (2003).
Dohan et al., "Sodium/iodide Symporter (NIS): characterization, regulation, and medical significance," Endocrine Reviews 24(1):48-77 (2003).
Earl et al., "T-Lymphocyte priming and protection against friend leukemia by vaccinia-retrovirus env gene recombinant," Science 234:728-731 (1986).
Eisenberger et al., "Viral vaccines for cancer immunotherapy," Hematol. Oncol. Clin. North Am. 20(3):661-687 (2006).
Emens, L., "Cancer vaccines:on the threshold of success," Expert Opin. Emerg. Drugs 13(2):295-308 (2008).
Eom et al., "Two distinct modes of cell death by doxorubicin: apoptosis and cell death through mitotic catastrophe accompanied by senescence-like phenotype," Oncogene 24(30):4765-4777 (2005).
Escher et al., "Bacterial luciferase αβfusion protein is fully active as a monomer and highly sensitive in vivo to elevated temperature," Proc. Natl. Acad. Sci. U.S.A. 86(17):6528-6532 (1989).
Esler et al., "Overflow of catecholamine neurotransmitters to the circulation: source, fate, and functions," Physiol. Rev. 70(4):963-985 (1990).
Estin et al, "Recombinant vaccinia virus vaccine against the human melanoma antigen p97 for use in immunotherapy," Proc. Natl. Acad. Sci. U.S.A. 85:1052-1056 (1988).
Everts et al., "Replication-selective oncolytic viruses in the treatment of cancer," Cancer Gene Ther. 12:141-161 (2005).
Falkner, F. and B. Moss, "Transient dominant selection of recombinant vaccinia viruses," J. Virol. 64(6):3108-2111 (1990).
Fodor et al., "Vaccinia virus mediated p53 gene therapy for bladder cancer in an orthotopic murine model," J. Urol. 173(2):604-9 (2005).
Foran et al., "Nucleotide sequence of the LuxA and LuxB genes of the bioluminescent marine bacterium *Vibrio fischeri*," Nucleic Acids Res. 16(2):777 (1988).
Forastiere et al., "Phase III comparison of high-dose paclitaxel + cisplatin + granulocyte colony-stimulating factor versus low-dose paclitaxel + cisplatin in advanced head and neck cancer: Eastern Cooperative Oncology Group Study E1393," J. Clin. Oncol. 19(4):1088-1095 (2001).
Gautam et al., "Delivery systems for pulmonary gene therapy," Am. J. Respir. Med. 1(1):35-46 (2002).
Genbank Accession No. M57977 (accessed Oct. 15, 2008) (11 pages).
Gil et al., "Utility of a herpes oncolytic virus for the detection of neural invasion by cancer," Neoplasia 10(4):347-353 (2008).
Glowniak et al., "Evaluation of a metaiodobenzylguanidine uptake by the norepinephrine, dopamine and serotonin transporters," J. Nucl. Med. 34(7):1140-1116 (1993).
Gnant et al., "Regional versus systemic delivery of recombinant vaccinia virus as suicide gene therapy for murine liver metastases," Ann. Surg. 230(3):352-361 (1999).
Gorecki, D., "Prospects and problems of gene therapy: an update," Expert Opin. Emerg. Drugs 6(2):187-198 (2001).
Green et al., "A matter of life and death," Cancer Cell 1:19-30 (2002).
Greer III et al., "Imaging of light emission from the expression of luciferases in living cells and organisms: a review," Luminescence 17(1):43-74 (2002).
Gribskov et al., "Sigma factors from *E. coli, B. subtilis,* phage SP01, and phage T4 are homologous proteins," Nucl. Acids Res. 14-6745-6763 (1986).
Groot-Wassink et al., "Adenovirus biodistribution and noninvasive imaging of gene expression in vivo by positron emission tomography using human sodium/iodide symporter as reporter gene," Hum. Gene Ther. 13:1723-1735 (2002).
Groot-Wassink et al., "Quantitative imaging of Na/I symporter transgene expression using positron emission tomography in the living animal," Mol. Ther. 9:436-442 (2004).
Gu et al., "Cell-specific sorting of biogenic amine transporters expressed in epithelial cells," J. Biol. Chem. 271:18100-18106 (1996).
Gu et al., "The $NH_2$-terminus of norepinephrine transporter contains a basolateral localization signal for epithelial cells," Mol. Cell Biol. 12:3797-3807 (2001).
Haberkorn et al., "Enhanced iodide transport after transfer of the human sodium iodide symporter gene is associated with lack of retention and low absorbed dose," Gene Ther. 10:774-780 (2003).
Haghighat et al., "Antitumor effect of IL-2, p53, and bax gene transfer in C6 glioma cells," Anticancer Res. 20(3A):1337-1342 (2000).
Hanahan et al., "The hallmarks of cancer," Cell 100:57-70 (2000).
Hauns, A. and D. Buchanan, "Pharmacological characterization of a fluorescent uptake assay for the noradrenaline transporter," J. Biomol. Screen. 12:378-384 (2007).
Hawkins et al., "Oncolytic biotherapy: a novel therapeutic platform," Lancet Oncol. 3(1):17-26 (2002).
Hermiston et al., "Armed therapeutic viruses: strategies and challenges to arming oncolytic viruses with therapeutic genes," Cancer Gene Ther. 9: 1022-1035 (2002).
Hermiston et al., "Genetically based therapeutics for cancer: similarities and contrasts with traditional drug discovery and development," Mol. Ther. 11(4):496-507 (2005).
Hershey et al., "Adjuvant immunotherapy of patients with high-risk melanoma using vaccinia viral lysates of melanoma: results of a randomized trial," J. Clin. Oncol. 20(20):4181-4190 (2002).
Hodge et al., "Induction of antitumor immunity by recombinant vaccinia viruses expressing B7-1 or B7-2 costimulatory molecules," Cancer Res. 54(21):5552-5555 (1994).
Ikeda et al., "Oncolytic virus therapy of multiple tumors in the brain requires suppression of innate and elicited antiviral responses," Nat. Med. (8):881-887 (1999).
Jia et al., "Viral vectors for cancer gene therapy: Viral dissemination and tumor targeting," Curr. Gene Ther. 5:133-142 (2005).
Jordan et al., "Single-dose safety and pharmacokinetics of ST-246, a novel othopoxvirus egress inhibitor," Antimicrob. Agents Ch. 52:1721-1727 (2008).
Jung et al., "The sodium/substrate symporter family: structural and functional features," FEBS Lett. 529:73-77 (2002).
Kang et al., "Establishment of a human hepatocellular carcinoma cell line highly expressing sodium iodide symporter for radionuclide gene therapy," J. Nucl. Med. 45:1571-1576 (2004).
Kantor et al., "Antitumor activity and immune responses induced by a recombinant carcinoembryonic antigen-vaccinia virus vaccine," J. Natl. Cancer Inst. 84:1084-1091 (1992).
Katz et al., "Mutations in the vaccinia virus A33R and B5R envelope proteins that enhance release of extracellular virions and eliminate formation of actin-containing microvilli without preventing tyrosine phosphorylation of the A36R protein," J. Virol. 77:12266-12275 (2003).

(56) References Cited

OTHER PUBLICATIONS

Kaufman et al., "A phase I trial of intra lesional RV-B7.1 vaccine in the treatment of malignant melanoma," Hum. Gene. Ther. 11(7):1065-1082 (2000).
Kaufman et al., "A recombinant vaccinia virus expressing human carcinoembryonic antigen CEA," Int. J. Cancer 48(6):900-907 (1991).
Kaufman et al., "Insertion of interleukin-2 (IL-2) and interleukin-12 (IL-12) genes into vaccinia virus results in effective anti-tumor responses without toxicity," Vaccine 20:1862-1869 (2002).
Kelly et al., "Novel oncolytic agent GLV-1h68 is effective against malignant pleural mesothelioma," Hum. Gene Ther. 19(8):774-782 (2008).
Kelly et al., "Attenuated multimutated herpes simplex virus-1 effectively treats prostate carcinomas with neural invasion while preserving nerve function," FASEB J. 22(6):1839-1848 (2008).
Kidner et al., "Advances in experimental and translational research in the treatment of hepatocellular carcinoma," Surg. Oncol. Clin. N. Am. 7(2):377-389 (2008).
Kihara et al., "Analysis of sequences required for the cytotoxic action of a chimeric toxin composed of *Pseudomonas* exotoxin and transforming growth factor α" Bioconj.Chem. 5:532-538 (1994).
Kim et al., "Systemic armed oncolytic and immunologic therapy for cancer with JX-594, a targeted poxvirus expressing GM-CSF," Mol. Ther. 14(3):361-370 (2006).
Kirn et al., "Replication-selective virotherapy for cancer: biological principles, risk management and future directions," Nat. Med. 7:781-787 (2001).
Kirn et al., "Replicating viruses as selective cancer therapeutics," Mol. Med. Today 2(12):519-527 (1996).
Kogai et al., "Enhancement of sodium/iodide symporter expression in thyroid and breast cancer," Endocrine-Related Cancer 13(3):797-826 (2006).
Krauss et al., "An investigation of incorporation of cellular antigens into vaccinia virus particles," J. Gen. Virol. 83: 2347-2359 (2002).
Lane et al., "Complications of smallpox vaccination, 1968: results of ten statewide surveys," J. Infect. Dis. 122-303-309 (1970).
Lane et al., "Complications of smallpox vaccinations, 1968: national surveillance in the United States" New Engl. J. Med. 281:1201-1208 (1969).
Lathe et al., "Tumour prevention and rejection with recombinant vaccinia," Nature (London) 326:878-880 (1987).
Lee et al., "Molecular attenuation of vaccinia virus: mutant generation and animal characterization," J. Virol. 66:2617-2630 (1992).
Leenders et al., "Blood to brain iron uptake in one Rhesus monkey using [Fe-52]-citrate and positron emission tomography (PET): influence of haloperidol," J. Neural. Transm. Suppl. 43:123-132 (1992).
Levy et al., "Characterization of the thyroid $Na^+/I^-$ symporter with an anti-COOH terminus antibody," Proc. Nat. Acad. Sci. U.S.A. 94: 5568-5573 (1997).
Levy et al., "N-linked glycosylation of the thyroid $Na^+/I^-$ symporter (NIS)," J. Biol. Chem. 273: 22657-22663 (1998).
Lewis et al., "Comparison of four $^{64}Cu$-labeled somatostatin analogues in vitro and in a tumor-bearing rat model: evaluation of new derivatives for positron emission tomography imaging and targeted radiotherapy," J. Med. Chem. 42(8):1341-1347 (1999).
Li et al., "Oncolytic virotherapy as personalized cancer vaccine," Int. J. Cancer 123:493-499 (2008).
Lill et al., "[28] Homologies and family relationships among $Na^+/Cl^-$ neurotransmitter transporters," Methods Enzymol. 296:425-436 (1998).
Lin et al., "Oncolytic vaccinia virotherapy of anaplastic thyroid cancer in vivo," J. Clin. Endocrinol. Metab. 93:4403-4407 (2008).
Lin, Z. and B. Madras, "Human genetics and pharmacology of neurotransmitter transporters," Handb. Exp. Pharmacol. (175):327-371 (2006).
Liu et al., "Expression of human granulocyte-macrophage colony stimulating factor (hGM-CSF) by recombinant vaccinia virus and its effect on immunogenicity," Zhonghua Shi Yan He Lin Chuang Bing Za Zhi 12(1):47-50 (1998). [article in the Chinese language preceeded by an English language abstract].
Liu et al., "Clinical trial results with oncolytic virotherapy: a century of promise, a decade of progress," Nat. Clin. Pract. Oncol. 4:101-116 (2007).
Lorenz et al., "Isolation and expression of cDNA encoding *Renilla reniformis* luciferase," Proc. Natl. Acad. Sci. U.S.A. 88(10):4438-4442 (1991).
Louie et al., "In vivo visualization of gene expression using magnetic resonance imaging," Nature Biotechnol. 18: 321-325 (2000).
Love et al., "Radionuclide imaging of Infection," J. Nucl. Med. Technol. 32(2):47-57; quiz 58-9 (2004).
Lusso, P., "Chemokines and viruses: the dearest enemies," Virology 273-228-240 (2000).
Mandela, P. and Ordway, G., "The norepinephrine transporter and its regulation," J. Neurochem. 97(2):310-333 (2006).
Mandell et al., "Radioisotope concentrator gene therapy using the sodium/iodide symporter gene," Cancer Res. 59:661-668 (1999).
Massoud et al., "Molecular imaging in living subjects: seeing fundamental biological processes in a new light," Genes Dev. 17:545-580 (2003).
Matz et al., "Fluorescent proteins from nonbioluminescent Anthozoa species," Nat. Biotech. 17: 969-973 (1999).
Mayford et al., "CaMKII regulates the frequency-response function of hippocampal synapses for the production of both LTD and LTP," Cell 81:891-904 (1995).
McAneny et al., "Results of a Phase I trial of a recombinant vaccinia virus that expresses carcinoembryonic antigen in patients with advanced colorectal cancer," Ann. Surg. Oncol. 3(5):495-500 (1996).
McCart et al., "Complex interaction between the replicating oncolytic effect and the enzyme/prodrug effect of vaccinia-mediated tumor regression," Gene Ther. 7:1217-1223 (2000).
McCart et al., "Oncolytic vaccinia virus expressing the human somatostatin receptor SSTR2: molecular imaging after systemic delivery using $^{111}In$-pentetreotide," Mol. Ther. 10(3):553-561 (2004).
McCart et al., "Systemic cancer therapy with a tumor-selective vaccinia virus mutant lacking thymidine kinase and vaccinia growth factor genes," Cancer Res. 61: 8751-8757 (2001).
McFadden, G., "Poxvirus tropism," Nat. Rev. Microbiol. 3(3):201-213 (2005).
Melikian et al., "Human norepinephrine transporter," J. Biol. Chem. 269(16):12290-12297 (1994).
Melikian et al., "Inability to N-glycosylate the human norepinephrine transporter reduces protein stability, surface trafficking, and transport activity but not ligand recognition," Mol. Pharmacol. 50:266-276 (1996).
Mikryukov et al., "Structural-functional organization of segment of vaccinia virus genome," Soviet Biotechnology (Biotekhnologiya) 4:19-25 (1988) [corresponds to pp. 442-449 in the Russian language edition].
Moore, A., "Effects of viruses on tumors," Annu. Rev. Microbiol. 8:393-402 (1954).
Moroz et al., "Imaging hNET reporter gene expression with 1241-MIBG" J. Nucl. Med. 48:827-836 (2007).
Moss, B., "Genetically engineered poxviruses for recombinant gene expression, vaccination, and safety," Proc. Natl. Acad. Sci. U.S.A. 93:11341-11348 (1996).
Moss, B., "Poxvirus vectors: cytoplasmic expression of transferred genes," Curr. Opin. Genet. Dev. 3:86-90 (1993).
Mukherjee et al., "Replication-restricted vaccinia as a cytokine gene therapy vector in cancer: persistent transgene expression despite antibody generation," Cancer Gene Ther. 7(5):663-70 (2000).
Mullen et al., "Viral oncolysis," The Oncologist 7:106-119 (2002).
Murphy et al., "An update on approaches to the development of respiratory syncytial virus (RSV) and parainfluenza virus type 3 (PIV3) vaccines," Virus Res. 32(1):13-26 (1994).
Mutschler et al., "10. Chemotherapy of Malignant Tumors," in: Drug Actions: Basic Principles and Therapeutic Aspects (medpharm (CRC Press), Suttgart, pp. 595-612 (1995).
Nagai et al., "A variant of yellow fluorescent protein with fast and efficient maturation for cell-biological applications," Nat. Biotechnol. 20(1):87-90 (2002).

(56) References Cited

OTHER PUBLICATIONS

Nagase et al., "Effects of intralesional versus ip administration of cisplatin on squamous cell carcinoma of mice," Cancer Treat. Rep. 71(9): 825-829 (1987).

Naik et al., "Intravenous and isolated limb perfusion delivery of wild type and tumor-selective replicating mutant vaccinia virus in nonhuman primates," Hum. Gene Ther. 17:30-45 (2006).

NCBI Protein AAA48282 (date of last modification Apr. 14, 2000) (1 page).

Needleman et al., "A general method applicable to the search for similarities in the aminio acid sequences of two proteins," J. Mol. Biol. 48:443-453 (1970).

Nguyen et al., "N-linked oligosaccharides are required for cell surface expression of the norepinephrine transporter but do not influence substrate or inhibitor recognition," J. Neurochem. 67:645-655 (1996).

Nguyen, A. and P. Daugherty, "Evolutionary optimization of fluorescent proteins for intracellular FRET," Nat Biotechnol. 23(3):353-360 (2005).

Niu et al., "Multimodality noninvasive imaging of gene transfer using the human sodium iodide symporter," J. Nucl. Med. 45:445-449 (2004).

Nogrady, "Medicinal Chemistry. A Biochemical Approach," New York: Oxford University Press, pp. 388-392 (1985).

Novellino et al., "A listing of human tumor antigens recognized antigens recognized by T cells: Mar. 2004 update," Cancer Immunol. Immunother. 54(3):187-207 (2005).

Ober et al., "Immunogenicity and safety of defective vaccinia virus lister: comparison with modified vaccinia virus Ankara," J. Virol. 76(15): 7713-7723 (2002).

Oertli et al., "Non-replicating recombinant vaccinia virus encoding murine B-7 molecules effective costimulation of naive CD4+ splenocytes in vitro," J. Gen. Virol. 77:3121-3125 (1996).

Özbek et al., "The designer cytokine hyper-IL-6 mediates growth inhibition and GM-CSF-dependent rejection of B16 melanoma cells," Oncogene 20(8): 972-979 (2001).

Pacholcznyk et al., "Expression cloning of a cocaine- and antidepressant-sensitive human noradrenaline transporter," Nature 350:350-354 (1991).

Parato et al., "Recent progress in the battle between oncolytic viruses and tumours," Nature Rev. 5:965-976 (2005).

Parish, C., "Cancer immunotherapy: the past, the present and the future," Immunol. Cell Biol. 81(2):106-113 (2003).

Patel et al., "A poxvirus-derived vector that directs high levels of expression of cloned genes in mammalian cells," Proc. Natl. Acad. Sci. U.S.A. 85:9431-9435 (1988).

Pearson et al., "Improved tools for biological sequence comparison," Proc. Natl. Acad. Sci. U.S.A. 85:2444-2448 (1988).

Peplinski et al., "Vaccinia virus for human gene therapy," Surg. Oncol. Clin. N. Am. 7(3): 575-588 (1998).

Perkus et al., "Recombinant vaccinia virus: immunization against multiple pathogens," Science 229(4717):981-984 (1985).

Pfleiderer et al., "A novel vaccinia virus expression system allowing construction of recombinants without the need for selection markers, plasmids and bacterial hosts," J. Gen. Virol. 76:2957-2962 (1995).

Pinkert et al., "An albumin enhancer located 10 kb upstream functions along with its promoter to direct efficient, liver-specific expression in transgenic mice," Genes Dev. 1:268:76 (1987).

Poptani et al., "Monitoring thymidine kinase and ganciclovir-induced changes in rat malignant glioma in vivo by nuclear magnetic resonance imaging," Cancer Gene Ther. 5(2): 101-109 (1998).

Prasher et al., "Primary structure of the *Aequorea victoris* green-fluorescent protein," Gene 111: 229-233 (1992).

Prasher et al., "Sequence comparison of complementary DNAs encoding Aequorin isotypes," Biochem, 26: 1326-1332 (1987).

Puhlmann et al., "Thymidine kinase-deleted vaccinia virus expressing purine nucleoside phosphorylase as a vector for tumor-directed gene therapy," Hum. Gene Ther. 10(4):649-657 (1999).

Puhlmann et al., "Vaccinia virus as a vector for tumor-directed gene therapy: biodistribution of a thymidine kinase-deleted mutant," Cancer Gene Ther. 7(1):66-73 (2000).

Qin et al., "Construction of recombinant vaccinia virus expressing GM-CSF and its use as a tumor vaccine," Gene Ther. 3(1):59-66 (1996).

Quigg et al., "Assessment in vitro of a novel therapeutic strategy for glioma, combining herpes simplex virus HSV1716-mediated oncolysis with gene transfer and targeted radiotherapy," Med. Chem. 1(5):423-439 (2005).

Raab et al., "Four-color labeling of cell culture and tumors of live mice upon infection with: GFP-Ruc and RFP-CBG99 expressing Vaccinia virus strains," Proceedings of the 14th International Symposium on Bioluminescence & Chemiluminescence: Chemistry, Biology and Applications, World Scientific: Singapore, 197-200 (2007).

Rao et al., "Il-12 is an effective adjuvant to recombinant vaccinia virus-based tumor vaccines," J. Immunol. 156: 3357-3365 (1996).

Rathinavelu et al., "Expression of mdm-2 oncoprotein in the primary and metastatic sites of mammary tumor (GI-101) implanted athymic nude mice," Cancer Biochem. Biophys. 17(1-2):133-146 (1999).

Rhoden et al., "Cell-based imaging of sodium iodide symporter activity with the yellow fluorescent protein variant YFP-H148Q/II52L," Am. J. Physiol. 292(2):C814-C823 (2007).

Ricci et al., "Non-invasive radioiodine imaging for accurate quantitation of NIS reporter gene expression in transplanted hearts," Eur. J. Cadiothorac. Surg. 33(1):32-39 (2008).

Riedel et al., "Imaging hypoxia in orthotopic rat liver tumors with iodine 124-labeled iodoazomycin galactopyranoside PET," Radiology 248(2):561-570 (2008).

Riedel et al., "Post-transcriptional regulation of the sodium/iodide symporter by thyrotropin," J. Biol. Chem. 276: 21458-21463 (2001).

Ring, C., "Cytolytic viruses as potential anti-cancer agents," J. Gen. Virol. 83:491-502 (2002).

Rodriguez et al., "Expression of the firefly luciferase gene in vaccinia virus: A highly sensitive gene marker to follow virus dissemination in tissues of infected animals," Proc. Natl. Acad. Sci. U.S.A. 85: 1667-1671 (1988).

Rodriguez et al., "Highly attenuated vaccinia virus mutants for the generation of safe recombinant viruses," Proc. Natl. Acad. Sci. U.S. A. 86: 1287-1291 (1989).

Roth et al., "p53 as a target for cancer vaccines: recombinant canarypox virus vectors expressing p53 protect mice against lethal tumor cell challenge," Proc. Natl. Acad. Sci. U.S.A. 93: 4781-4786 (1996).

Rothenberg et al.,"Improving the evaluation of a new cancer treatments: challenges and opportunities," Nat. Rev. Cancer 3: 303-309 (2003).

Ruoho, A., "How the monoamine transporter garden grows," Mol. Pharmacol. 68(2):272-274 (2005).

Saier et al., "TCDB: the transporter classification database for membrane transport protein analyses and information," Nucleic Acids Res. 34(Database Issue):D181-D186 (2006).

Sandell et al., "Synthesis, radiolabeling and preliminary biological evaluation of radiolabeled 5-methyl-6-nitroquipazine, a potential radioligand for the serotonin transporter," Bioorg. Med. Chem. Lett. 12(24):3611-3613 (2002).

Schwartz, R. and M. Dayhoff, eds., "Atlas Of Protein Sequence And Structure," National Biomedical Research Foundation, pp. 353-358 (1979).

Serganova et al., "Non-invasive molecular imaging and reporter genes," Cent. Eur. J. Biol. 1(1):88-123 (2006).

Serganova et al., "Human reporter genes: potential use in clinical studies," Nucl. Med. Biol. 34(7):791-807(2007).

Shaner et al., "A guide to choosing fluorescent proteins," Nat. Methods 2(12):905-909 (2005).

Shen et al., "Fighting cancer with vaccinia virus: teaching new tricks to an old dog," Mol. Ther. 11(2):180-195 (2005).

Shida et al., "Effects and virulences of recombinant vaccinia viruses derived from attenuated strains that express the human T-cell leukemia virus type I envelope gene," J. Virol. 62(12):4474-4480 (1988).

(56) References Cited

OTHER PUBLICATIONS

Shimura et al., "Iodide uptake and experimental $^{131}$I therapy in transplanted undifferentiated thyroid cancer cells expressing the Na$^+$/I$^-$ symporter gene," Endocrinol. 138:4493-4496 (1997).
Shine, J. and L. Dalgarno, "Determinant of cistron specificity in bacterial ribosomes," Nature 254(5495):34-38 (1975).
Shkrob et al., "Far-red fluorescent proteins evolved from a blue chromoprotein from *Actinia equina*," Biochem. J. 392(Pt 3):649-654 (2005).
Shulkin et al., "Iodine-123-4-amino-3-iodobenzylguanidine, a new sympathoadrenal imaging agent: comparison with iodine-123 metaiodobenzylguanidine," J. Nucl. Med. 27:1138-1142 (1986).
Silva et al., "From actually toxic to highly specific—novel drugs against poxviruses," Virol. J. 4:8 (2007).
Sinkovies et al., "New developments in the virus therapy of cancer: a historical review," Intervirology 36:193-214 (1993).
Sivanandham et al., "Therapeutic effect of a vaccinia colon oncolysate prepared with interleukin-2-gene encoded vaccinia virus studied in a syngeneic CC-36 murine colon hepatic metastasis model," Cancer Immunol. Immunother. 38:259-264 (1994).
Sivanandham et al., "Colon cancer cell vaccine prepared with replication-deficient vaccinia viruses encoding B7.1 and interleukin-2 induce antitumor response in syngeneic mice," Cancer Immunol. Immunother. 46(5):261-267 (1998).
Smirne et al., "Vascular endothelial growth factor. From basic research to clinical application," Minerva Med. 90(1-2):15-23 (1999) [article in Italian with English language abstract].
Smith et al., "Host range selection of vaccinia recombinants containing insertions of foreign genes into non-coding sequences," Vaccine 11(1):43-53 (1993).
Smith et al., "Comparison of biosequences," Adv. Appl. Math. 2:482-489 (1981).
Sroller et al., "Effect of 3-beta-hydroxysteroid dehydrogenase gene deletion on virulence and immunogenicity of different vaccinia viruses and their recombinants," Arch. Virol. 143:1311-1320 (1998).
St. Louis University, "A new way to kill cancer: SLU research shows viruses can destroy lung, colon tumors," retrieved from the Internet:<URL: sciencedaily.com/releases/2004/05/040517071951.htm [retrieved on Jun. 3, 2010] [2 pages].
Steele et al., "Recent developments in the virus therapy of cancer," P.S.E.B.M. 223:118-127 (2000).
Stienlauf et al., "Kinetics of formation of neutralizing antibodies against vaccinia virus following re-vaccination," Vaccine 17:201-204 (1999).
Stritzker et al., "Evaluation of an in vivo gene induction system in infected tumor-bearing mice," Proceedings of the 14th International Symposium on Bioluminescence & Chemiluminescence: Chemistry, Biology and Applications. World Scientific: Singapore: 205-208 (2007).
Sugimoto et al., "Characteristics of an attenuated vaccinia virus strain, LC16m0, and its recombinant virus vaccines," Vaccine 12(8):675-681 (1994).
Surratt et al., "Recognition of psychostimulants, antidepressants, and other inhibitors of synaptic neurotransmitter uptake by the plasma membrane monoamine transporters," The AAPS Journal 7(3):E739-E751 (2005).
Sutter et al., "Vaccinia vectors as candidate vaccines: The development of modified vaccinia virus Ankara for antigen delivery," Curr. Drug Targets—Infectious Disorders 3(3):263-271 (2003).
Tartaglia et al., "NYVAC: a highly attenuated strain of vaccinia virus," Virology 188(1):217-232 (1992).
Taylor et al., "Comparison of the virulence of wild-type thymidine kinase (tk)-deficient and tk+ phenotypes of vaccinia virus recombinants after intranasal inoculation of mice," J. Gen. Virol. 72 (Pt 1):125-130 (1991).
Tellioglu et al., "Genetic or acquired deficits in the norepinephrine transporter: current understanding of clinical implications," Expert Rev. Mol. Med. 3(29):1-10 (2001).
Theon et al., "Intratumoral chemotherapy with cisplatin in oily emulsion in horses," J. Am. Vet. Med. Assoc. 202(2):261-267 (1993).

Thorne et al. "Future directions for the field of oncolytic virotherapy: a perspective on the use of vaccinia virus," Expert Opin. Biol. Ther. 4(8): 1307-1321 (2004).
Thorne et al., "Rational strain selection and engineering creates a broad-spectrum, systemically effective oncolytic poxvirus, JX-963," J. Clin. Invest. 117:3350-3358 (2007).
Thorne et al., "The use of oncolytic vaccinia viruses in the treatment of cancer: a new role for an old ally?" Curr. Gene Ther. 5:429-443 (2005).
Thorne et al., "Vaccinia virus and oncolytic virotherapy of cancer," Curr. Opin. Mol. Ther. 7(4):359-365 (2005).
Timiriasova et al., "Analysis of reporter gene expression at different segments of the vaccinia virus genome," Mol. Biol. (Mosk.) 27(2):392-401 (1993) [article in Russan, English abstract on last page of article].
Timiryasova et al., "Antitumor effect of vaccinia virus in glioma model," Oncol. Res. 11(3):133-144 (1999).
Timiryasova et al., "Replication-deficient vaccinia virus gene therapy vector: evalution of exogenous gene expression mediated by PUV-inactivated virus in glioma cells," J. Gene Med. 3:468-477 (2001).
Timiryasova et al., "Visualization of vaccinia virus infection using the renilla-luciferase-GFP fusion protein," Bioluminescence & chemiluminescence: Proceedings of the 11th International Symposium on Bioluminescence Chemiluminescence: Asilomar Conference Grounds, Pacific Grove, Monterey, California: Sep. 6-10, 2000 / (eds.): Case, J.F. et al., World Scientific Publishing Co. (c2001), pp. 457-460.
Timiryasova et al., "Construction of recombinant vaccinia viruses using PUV-inactivated virus as a helper," BioTechniques 31:534-540 (2001).
Timiryasova et al., "Vaccinia virus-mediated expression of wild-type p53 suppresses glioma cell growth and induces apoptosis," Int. J. Oncol. 14(5):845-854 (1999).
Toguchi et al., "Suicide gene therapy of C6 glioma cells mediated by replication-deficient and replication competent vaccinia viruses," Cancer Gene Ther. 10:S32 (2003) presented at the Eleventh International Conference on Gene Therapy of Cancer, Dec. 12-14, 2002, San Diego California.
Van Sande et al., "Anion selectivity by the sodium iodide symporter," Endocrinology 144:247-252 (2003).
VECTOR: Ministry of Public Health and Social Development of Russian Federation, State Research Center of Virology and Biotechnology, "WHO Collaborating Centre for Orthopoxvirus Diagnosis and Repository for Variola Virus Strains and DNA," retrieved from the Internet:<URL: vector.nsc.ru/DesktopDefault.aspx?1cid=9&tabid=294&tabindex=1 [retrieved on Nov. 3, 2008] [1 page].
Vidal et al., "Tissue-specific control elements of the Thy-1 gene," EMBO J. 9(3):833-840 (1990).
Wang et al., "Clonal persistence and evolution during a decade of recurrent melanoma," J. Invest. Dermatol. 126(6):1372-1377 (2006).
Wang et al., "Evolution of new nonantibody proteins via iterative somatic hypermutation," Proc. Natl. Acad. Sci. U.S.A. 101(48):16745-16749 (2004).
Wapnir et al., "Immunohistochemical profile of the sodium/iodide symporter in thyroid, breast, and other carcinomas using high density tissue microarrays and conventional sections," J. Clin. End. Met. 88:1880-1888 (2003).
Watson et al., "Molecular Biology of the Gene," 4th Edition, 1987, The Benjamin/Cummings Pub. co., p. 224.
Wiedenmann et al., "A far-red fluorescent protein with fast maturation and reduced oligomerization tendency from *Entacmaea and quadricolor* (Anthozoa, Actinaria)," Proc. Natl. Acad. Sci. U.S.A. 99(18):11646-11651 (2002).
Wisher, M., "Biosafety and product release testing issues relevant to replication-competent oncolytic viruses," Cancer Gene Ther. 9(2):1056-1061 (2002).
Woo et al., "Advances in oncolytic viral therapy," Curr. Opin. Investig. Drugs 7:549-559 (2006).
Wu et al., "High-resolution microPET imaging of carcinoembryonic antigen-positive xenografts by using a copper-64-labeled engineered antibody fragment," Proc. Natl. Acad. Sci. U.S.A. 97(15):8495-8500 (2002).

(56) References Cited

OTHER PUBLICATIONS

Xiong et al., "Cell cycle dependent antagonistic interactions between Paclitaxel and Carboplatin in combination therapy," Cancer Biol. Ther. 6(7):1067-1073 (2007).
Yettra, M., "Remission of chronic lymphocytic leukemia after smallpox vaccination," Arch. Intern. Med. 139(5):603 (1979).
Yu et al. "Visualization of tumors and metastases in live animals with bacteria and vaccinia virus encoding light-emitting proteins," Nat. Biotech. 22(3): 313-320 (2004).
Yu et al., "A Renilla luciferase-Aequorea GFP (ruc-gfp) fusion gene construct permits real-time detection of promoter activation by exogenously administered mifepristone in vivo," Mol. Genet. Genomics 268(2):169-178 (2002).
Yu et al., "Optical imaging: bacteria, viruses, and mammalian cells encoding light-emitting proteins reveal the locations of primary tumors and metastases in animals," Anal. Bioanal. Chem. 377(6):964-972 (2003).
Yu et al., "Visualization of molecular and cellular events with green fluorescent proteins in developing embryos: a review," Luminescence 18(1):1-18 (2003) [Erratum in: Luminescence 18(4):243 (2003)].
Zeh et al., "Development of a replication-selective, oncolytic poxvirus for the treatment of human cancers," Cancer Gene Ther. 9:1001-1012 (2002).
Zhang et al., "Eradication of solid human breast tumors in nude mice with an intravenously injected light emitting oncolytic vaccinia virus," Cancer Res. 67(20):10038-10046 (2007).
Zhou, J., "Norepinephrine transporter inhibitors and their therapeutic potential," Drugs Future 29(12):1235-1244 (2004).
Zimmermann et al., "Independent regulatory elements in the nestin gene direct transgene expression to neural stem cells," Neuron 12: 11-24 (1994).
Letter/Written Disclosure of the Information Disclosure Statement for the above-referenced application (U.S. Appl. No. 12/660,314), mailed on Jun. 29, 2012, 3 pages.
Advani et al., "Oncolytic vaccinia virus encoding an anti-VEGF antibody improves the efficacy of fractionated radiotherapy in tumor xenografts," Poster, ASTRO 53rd Annual Meeting, Miami Beach, FL, Oct. 2-6, 2011 [1 page].
Advani et al., "Preferential replication of systemically delivered oncolytic vaccinia virus to focally irradiated glioma xenografts," Clin Cancer Res., 18(9):2579-2590 (2012), Published online Feb. 29, 2012.
Altmann et al., "Increased MIBG uptake after transfer of the human norepinephrine transporter gene in rat hepatoma," J. Nucl. Med. 44(6):973-980. (2003).
Ascierto et al., "Permissivity of the NCI-60 cancer cell lines to oncolytic vaccinia virus GLV-1H68," BMC Cancer 11(1):451 (2011), 28 pages.
Benning, N. and Hasset, N., "Vaccinia virus infection during murine pregnancy: a new pathogenesis model for vaccinia fetalis," J. Virol. 78(6):3133-3139 (2004).
Black, M. and D. Hruby, "A single amino acid substitution abolishes feedback inhibition of vaccinia virus thymidine kinase," J. Biol. Chem. 267(14):9743-9748 (1992).
Carlin et al., "In Vitro cytotoxicity of [(211)At]astatide and [131 I]iodide to glioma tumor cells expressing the sodium iodide symporter," J. Nucl. Med. 44(11):1827-1838 (2003).
Chen et al., "Replication efficiency of oncolytic vaccinia virus in cell cultures prognosticates the virulence and antitumor efficacy in mice," J. Translational Med. 9(1):164 epub date Sep. 27, 2011, 11 pages.
Cho et al., "Expression and activity of human Na+/I− symporter in human glioma cells by adenovirus-mediated gene delivery," Gene Ther. 7(9):740-749 (2000).
Corral et al., "Phase I clinical trial of genetically modified and oncolytic vaccinia virus GL-ONC1 with green fluorescent protein imaging," 7th NCRI Cancer Conference, Liverpool, UK. Nov. 6-9, 2011, poster, 1 page.
Corral et al., "Phase I clinical trial of genetically modified and oncolytic vaccinia virus GL-ONC1 with green fluorescent protein imaging," 7th NCRI Cancer Conference, Liverpool, UK. Nov. 6-9, 2011, abstract, 2 pages.
Dai et al., "Cloning and characterization of the thyroid iodide transporter," Nature 379(6564):458-460 (1996).
De Clercq, E., "Acyclic nucleoside phosphonates: a new dimension to the chemotherapy of DNA virus and retrovirus infections," J. Med. Microbiol. 47(1):1-3 (1998).
Dingli et al., "Genetically targeted radiotherapy for multiple myeloma," Blood 102(2):489-496 (2003).
Dingli et al., "Image-guided radiovirotherapy for multiple myeloma using a recombinant measles virus expressing the thyroidal sodium iodide symporter," Blood 103(5):1641-1646 (2004).
Doubrovin et al., "In vivo imaging and quantitation of adoptively transferred human antigen-specific T cells transduced to express a human norepinephrine transporter gene," Cancer Res., 15:67(24):11959-11969 (2007).
Frentzen et al., "Anti-VEGF single chain antibody GLAF-1 encoded by oncolytic vaccinia virus significantly enhances antitumor therapy," Proc. Natl. Acad. Sci. U.S.A. 106(31):12915-12920 (2009).
Gentschev et al., "Regression of human prostate tumors and metastases in nude mice following treatment with the recombinant oncolytic vaccinia virus GLV-1h68," J. Biomed. Biotechnol. 2010:1-11 (2010).
Gentschev et al., "Efficient colonization and therapy of human hepatocellular carcinoma (HCC) using the oncolytic vaccinia virus strain GLV-1h68," PLoS One. 6(7):1-9 (2011).
Gentschev et al., "Preclinical evaluation of oncolytic vaccinia virus for therapy of canine soft tissue sarcoma," PLoS One 7:(5)37239, 12 pages (2012).
Gholami et al., "Novel therapy for anaplastic thyroid carcinoma cells using an oncolytic vaccinia virus carrying the human sodium iodide symporter," Surgery 150(6):1040-1047 (2011).
Goel et al., "Radioiodide imaging and radiovirotherapy of multiple myeloma using VSV(Δ51)-NIS, an attenuated vesicular stomatitis virus encoding the sodium iodide symporter gene," Blood 110(7): 2342-2350 (2007).
Haddad et al., "A novel genetically modified oncolytic vaccinia virus is effective against a wide range of human cancers," Annals of Surgical Oncology, Epub ahead of print Jan. 19, 2012, 10 pages.
Harrington, K., "GL-ONC1 phase I trial at royal marsden hospital," Roche-Genelux Meeting, Penzberg, Germany, Sep. 19, 2011, poster, 25 pages.
He et al., "Effective oncolytic vaccinia therapy for human sarcomas," J. Surg. Res. 175(2):e53-e60 (2012).
Karupiah et al., "Vaccinia virus-mediated damage of murine ovaries and protection by viruses-expressed interleukin-2," Immunol. Cell Biol. 68: 325-333 (1990).
Mackett et al., "General method for production and selection of infectious vaccinia virus recombinants expressing foreign genes," J. Virol., 49(3):857-864 (1984).
McFadden, G., "Gleevec casts a pox on poxviruses," Nat. Med. 11(7):711-712 (2005).
Metzger et al., "Human cytomegalovirus UL97 kinase confers ganciclovir susceptibility to recombinant vaccinia virus," J. Virol. 68(12):8423-8427 (1994).
Pedersen et al., "A phase I clinical trial of genetically modified and imageable oncolytic vaccinia virus GL-ONC1 with clinical green fluorescent protein (GFP) imaging," J. Clin. Oncol 29: 2011 (abstr 2577) abstract, 2 pages. ASCO Annual Meeting, Jun. 3-7, 2011, 2 pages.
Pedersen et al., "A phase I clinical trial of genetically modified and imageable oncolytic vaccinia virus GL-ONC1 with clinical green fluorescent protein (GFP) imaging," J. Clin. Oncol 29: 2011 (abstr 2577) poster, 1 page. ASCO Annual Meeting, Jun. 3-7, 2011, 1 page.
Reeves et al., "Disabling poxvirus pathogenesis by inhibition of Abl-family tyrosine kinases," Nat. Med. 11(7):731-739 (2005).
Ruiz et al., "Synthesis and antiviral evaluation of alkoxyalkyl-phosphate conjugates of cidofovir and adefovir," Antivir. Res. 75(1):87-90 (2007).

(56) References Cited

OTHER PUBLICATIONS

Scheiflinger et al., "Construction of chimeric vaccinia viruses by molecular cloning and packaging," Proc. Natl. Acad. Sci. 89:9977-9981 (1992).
Smanik et al., "Cloning of the human sodium iodide symporter," Biochem. Biophys. Res. Commun. 226: 339-345 (1996).
Spitzweg et al., "Prostate-specific antigen (PSA) promoter-driven androgen-inducible expression of sodium iodide symporter in prostate cancer cell lines," Cancer Res. 59(9):2136-2141 (1999).
Stockert et al., "A Survey of the humoral immune response of cancer patients to a panel of human tumor antigens," J. Exp. Med. 187(8):1349-1354 (1998).
Sturm et al., "Functional hyper-IL-6 from vaccinia virus-colonized tumors triggers platelet formation and helps to alleviate toxicity of mitomycin C enhanced virus therapy," J. Transl. Med. 10(1):9 (2012) [epub ahead of print Jan. 11, 2012], 40 pages.
Topalis et al., "Substrate specificity of vaccinia virus thymidylate kinase," FEBS J. 272(24):6254-6265 (2005).
Yang et al., "An orally bioavailable antipoxvirus compound (ST-246) inhibits extracellular virus formation and protects mice from lethal orthopoxvirus challenge," J. Virol. 79:13139-13149 (2005).
Yu et al., "Real-time imaging of tumors using replication-competent light emitting microorganisms," Methods Mol. Biol. 872:159-175 (2012).
Office Action, issued Dec. 12, 2011, in connection with corresponding U.S. Appl. No. 12/157,960, 16 pages.
Examination Report, issued Jan. 9, 2012, in connection with corresponding Canadian Patent Application No. 2,690,627, 3 pages.
Response to Communication dated Jan. 24, 2011, sent Nov. 18, 2011, in connection with corresponding European Patent Application No. 08768418.9, 35 pages.
Examination Report, issued May 14, 2012, in connection with corresponding European Patent Application No. 08768418.9, 6 pages.
Official Action, issued Jun. 5, 2012, in connection with corresponding Japanese Patent Application No. 2010-512192, 4 pages.
International Search Report and Written Opinion, issued Jan. 26, 2009, in connection with International Application No. PCT/US2008/007377, 8 pages.
Examination Report, issued Mar. 31, 2011, in connection with related European Patent Application No. 08794597.8, 10 pages.
Examination Report, issued May 16, 2011, in connection with related European Patent Application No. 10003287.9, 11 pages.
Letter/Written Disclosure of the Information Disclosure Statement for the above-referenced application (U.S. Appl. No. 12/660,314), mailed on Jun. 18, 2010, 4 pages.
International Search Report and Written Opinion, issued May 12, 2009, in connection with International Patent Application No. PCT/US2008/007377, 14 pages.
International Preliminary Report on Patentability, issued Sep. 24, 2009, in connection with International Patent Application No. PCT/US2008/007377, 19 pages.
Brader et al., "Imaging genetically engineered oncolytic vaccinia virus (GLV-1h99) using a human norepinephrine transporter reporter gene," Clin. Cancer Res. 15(11):3791-3801 (2009).
Chen et al., "A novel recombinant vaccinia virus expressing the human norepinephrine transporter retains oncolytic potential and facilitates deep tissue imaging," Mol. Med. 15(5-6):144-151 (2009).
Gentschev et al., "Use of an oncolytic vaccinia virus for treatment of canine breast cancer in nude mice: preclinical development of a therapeutic agent," Cancer Gene Ther. 16(4):320-328 (2009).
Kelly et al., "Real-time intraoperative detection of melanoma lymph node metastases using recombinant vaccinia virus GLV-1h68 in an immunocompetent animal model," Int. J. Cancer 124(4):911-918 (2009).
Yu et al., "Regression of human pancreatic tumor xenografts in mice after a single systemic injection of recombinant vaccinia virus GLV-1h68," Mol. Cancer Ther. 8:141-151 (2009).
Letter/Written Disclosure of the Supplemental Information Disclosure Statement for the above-referenced application, mailed on the same day herewith, 2 pages.

Examination Report, issued Mar. 27, 2013 (received Apr. 11, 2013), in connection with corresponding Canadian Patent Application No. 2,690,627, 8 pages.
Letter/Written Disclosure of the Information Disclosure Statement for the above-referenced application (U.S. Appl. No. 12/660,314), mailed on Mar. 14, 2013, 2 pages.
AACR Press Release Sep. 15, 2011, Virus shows promise for imaging and treating pancreatic cancer, Published on Sep. 15, 2011 [online][retrieved on Jan. 28, 2013] Retrieved from:<URL:aacr.org/home/public--media/aacr-press-releases.aspx?d=2438 [2 pages].
Chen et al., "Oncolytic viruses," Advances in Virology, 2 pages (2012).
Chen et al., "Oncolytic vaccinia virus: a theranostic agent for cancer," Future Virology, 5(6):763-784 (2010).
Chen et al., "Tropism of oncolytic vaccinia virus constructs for human mononuclear cell subsets," 27th Annual Meeting Final Program, Society for Immunotherapy of Cancer (SITC), Oct. 26-28, 2012, North Bethesda MD., 1 page [oral presentation abstract].
Chernichenko et al., "Oncolytic vaccinia therapy of salivary gland carcinoma," JAMA Otolaryngol Head Neck Surg 139(2): 173-182, (2013).
Donat et al., "Preferential colonization of metastases by oncolytic vaccinia virus strain GLV-1h68 in a human PC-3 prostate cancer model in nude mice," PLOS ONE 7(9):e45942, 13 pages (2012).
Genelux Press Release Nov. 1, 2012, "Genelux corporation announces early results of a phase I/II clinical trial of virotherapeutic GL-ONC1 in advanced peritoneal cavity cancers," [online] Published on Nov. 1, 2012 [online][retrieved on Jan. 28, 2013] Retrieved from:<URL:genelux.com/genelux2012/?page_id=4157 [3 pages].
Genelux Press Release Jun. 28, 2012, "Genelux corporation announces ground-breaking clinical study evaluating oncolytic vaccinia virus in canine cancer patients," [online] Published on Jun. 28, 2012 [online][retrieved on Jan. 28, 2013] Retrieved from:<URL:genelux.com/genelux2012/?page_id=3824 [2 pages].
Genelux Press Release Jun. 14, 2012, "Genelux corporation announces first patient dosed in phase I combination clinical trial of GL-ONC1," [online] Published on Jun. 14, 2012 [online][retrieved on Jan. 28, 2013] Retrieved from:<URL:genelux.com/genelux2012/?page_id=2701 [2 pages].
Genelux Press Release May 31, 2012, "Genelux corporation announces treatment of first patient in phase I/II clinical trial of GL-ONC1 in advanced peritoneal cavity cancers," [online] Published on May 31, 2012 [online][retrieved on Jan. 28, 2013] Retrieved from:<URL:genelux.com/genelux2012/?page_id=2691 [2 pages].
Genelux Press Release May 30, 2012, "Genelux corporation announces phase 1 data presentation at 2012 ASCO Annual Meeting of GL-ONC1, its oncolytic virus lead product candidate," [online] Published on May 30, 2012 [online][retrieved on Jan. 28, 2013] Retrieved from:<URL:genelux.com/genelux2012/?page_id=2686 &preview=true [2 pages].
Genelux Press Release Jun. 6, 2011, "ASCO poster presentation unveils preliminary results of phase I clinical trial involving intraveneous administration of GL-ONC1 to patients with advanced solid tumor cancers," [online] Published on Jun. 6, 2011 [retrieved on Jan. 28, 2013] Retrieved from:<URL: genelux.com/genelux2012/?page_id=1357 [1 page].
Gentschev et al., "Characterization and evaluation of a new oncolytic Vaccinia Virus strain LIVP6.1.1 for canine cancer therapy," Bioengineered 4:2 1-6, (2013).
Gholami et al., "Vaccinia virus GLV-1h153 is effective in treating and preventing metastatic triple-negative negative breast cancer," Annals of Surgery 256(3):437-445, (2012).
Haddad et al., "Imaging characteristics, tissue distribution, and spread of a novel oncolytic vaccinia virus carrying the human sodium iodide symporter," PLoS One 7(8):e41647, 9 pages. (2012).
Haddad et al., "A vaccinia virus encoding the human sodium iodide symporter facilitates long-term image monitoring of virotherapy and targeted radiotherapy of pancreatic cancer," J. Nucl. Med. 53:1933-1942, (2012).
Patil et al., "Virotherapy of canine tumors with oncolytic vaccinia virus GLV-1h109 expressing an anti-VEGF single-chain antibody," PLoS One 7(10):e47472, 13 pages (2012).

(56) References Cited

OTHER PUBLICATIONS

Reinboth et al., "Correlates between host and viral transcriptional program associated with different oncolytic vaccinia virus isolates," Hum Gene Ther Methods, 23(5):285-296, (2012).

Reinboth et al., "Correlation between human and oncolytic vaccinia virus transcriptional profile," 27th Annual Meeting Final Program, Society for Immunotherapy of Cancer (SITC), Oct. 26-28, 2012, North Bethesda MD. [Poster 82 abstract] 1 page.

Wang et al., "Oncolytic vaccinia virus GLV-1h68 strain shows enhanced replication in human breast cancer stem-like cells in comparison to breast cancer cells," J. Transl. Med. 10(1):167, 28 pages (2012).

Weibel et al., "Imaging of intratumoral inflammation during oncolytic virotherapy of tumors by 19F-Magnetic resonance imaging (MRI)," PLoS One 8(2):e56317, 12 pages (2013).

Weintraub, A., "Pet dogs help biotech startups find new weapons to fight cancer," X conomy, Jul. 25, 2012, [online] [retrieved on Jan. 28, 2013] [Retrieved from:<URL:xconomy.com/san-diego/2012/07/25/pet-dogs-help-biotech-startups-find-new-weapons-to-fight-cancer/?single_page=true], 7 pages.

Office Action, issued Oct. 23, 2012, in connection with corresponding U.S. Appl. No. 13/506,738, 11 pages.

Response to Examiner's Report issued Jan. 9, 2012, in connection with corresponding Canadian Application No. 2,690,627, mailed Dec. 10, 2012, 57 pages.

Response to Examination Report issued May 14, 2012, in connection with corresponding European Patent Application No. 08768418.9, mailed Nov. 23, 2012, 10 pages.

Response to Official Action dated Jun. 5, 2012, in connection with corresponding Japanese Patent Application No. 2010-512192, mailed Dec. 4, 2012, 54 pages. [Response in Japanese with English translation of claims and English Response instructions to Foreign Associate].

Letter/Written Disclosure of the Information Disclosure Statement for the above-referenced application, mailed on Oct. 4, 2013, 2 pages.

Arbab et al., "In Vivo cellular imaging for translational medical research," Current Medical Imaging Reviews 5:19-38 (2009).

Belin et al., "An oncolytic vaccinia virus expressing the human sodium iodine symporter prolongs survival and facilitates SPECT/CT imaging in an orthotopic model of malignant pleural mesothelioma," Surgery 154(3):486-495 (2013).

Kyula et al., "Synergistic cytotoxicity of radiation and oncolytic Lister strain vaccinia in V600D/EBRAF mutant melanoma depends on JNK and TNF-alpha signaling," Oncogene doi:10.1038/onc.2013.112, 1-13, (2013).

Wang et al., "Optical detection of viable tumor cells in liquid biopsies and their therapy in body fluids with oncolytic vaccinia virus," Journal of Nuclear Medicine 54(1):25 (2013).

Wang et al., "Optical detection and virotherapy of live metastatic tumor cells in body fluids with vaccinia strains," PLoS One 3:8(9):e71105, 12 pages (2013).

Restriction Requirement, issued Feb. 5, 2010, in connection with corresponding U.S. Appl. No. 12/157,960, 12 pages.

Response to Restriction Requirement, submitted Aug. 5, 2010, in connection with corresponding U.S. Appl. No. 12/157,960, 6 pages.

Restriction Requirement, issued Oct. 27, 2010, in connection with corresponding U.S. Appl. No. 12/157,960, 6 pages.

Response to Restriction Requirement, submitted Nov. 4, 2010, in connection with corresponding U.S. Appl. No. 12/157,960, 6 pages.

Office Action, issued Mar. 3, 2011, in connection with corresponding U.S. Appl. No. 12/157,960, 13 pages.

Response to Office Action, submitted Sep. 12, 2011, in connection with corresponding U.S. Appl. No. 12/157,960, 28 pages.

Supplemental Response to Office Action, submitted Sep. 28, 2011, in connection with corresponding U.S. Appl. No. 12/157,960, 47 pages.

Response to Examiner's Report, submitted May 8, 2013, in connection with corresponding Canadian Application No. 2,690,627, 14 pages.

Letter/Written Disclosure of the Information Disclosure Statement for the above-referenced application, mailed on Apr. 11, 2014, 2 pages.

Ahrens et al., "In vivo imaging platform for tracking immunotherapeutic cells," Nature Biotechnology 23(8):983-987 (2005).

Buckel et al., "Combination of fractionated irradiation with anti-VEGF expressing vaccinia virus therapy enhances tumor control by simultaneous radiosensitization of tumor associated endothelium," Int. J. Cancer 133(12):2989-2999 (2013).

Buursma et al., "$^{18}$F-FEAU as a radiotracer for herpes simplex virus thymidine kinase gene expression: in-vitro comparison with other PET tracers," Nucl. Med. Commun.27:25-30 (2006).

Chudakov et al., "Fluorescent proteins and their applications in imaging living cells and tissues," Physiol Rev 90:1103-1163 (2010).

ClinicalTrials.gov, "A Study of GL-ONC1, an oncolytic vaccinia virus, in patients with advanced peritoneal carcinomatosis," [online][retrieved on Oct. 7, 2013] Retrieved from: <URL:clinicaltrials.gov/ct2/show?term=genelux&rank=1>, 4 pages.

ClinicalTrials.gov, "Intra-pleural administration of GL-ONC1, a genetically modified vaccinia virus, in patients with malignant pleural effusion: primary, metastases and mesothelioma," [online][retrieved on Oct. 7, 2013] Retrieved from:<URL:clinicaltrials.gov/ct2/show?term=genelux&rank=4>, 4 pages.

ClinicalTrials.gov, "Safety study of attenuated vaccinia virus (GL-ONC1)with combination therapy in head & neck cancer," [online][retrieved on Oct. 7, 2013] Retrieved from:<URL:clinicaltrials.gov/ct2/show?term=genelux&rank=2>, 4 pages.

Dai et al., "Oncolytic vaccinia virus in combination with radiation shows synergistic antitumor efficacy in pancreatic cancer," Cancer Lett [Epub ahead of print Dec. 7, 2013]. pii: S0304-3835(13)00809-4, doi:10.1016/j.canlet.2013.11.007, 15 pages. (2013).

Donaldson et al., "A rapid detection method for Vaccinia virus, the surrogate for smallpox virus," Biosensors and Bioelectronics 20:322-327 (2004).

Duggal et al., "Vaccinia virus expressing bone morphogenetic protein-4 in novel glioblastoma orthotopic models facilitates enchanced tumor regression and long-term survival," J. of Translational Medicine 11:155 doi:10.1186/1479-5876-11-155, 14 pages (2013).

Ehrig et al, "Growth inhibition of different human colorectal cancer xenografts after a single intravenous injection of oncolytic vaccinia virus GLV-1h68," Journal of Translation Medicine 11:79, 32 pages (2013).

Fikes, B. "New tool finds, fights cancer," San Diego Union-Tribune, Published Feb. 11, 2013, 1 page (2013).

Genelux Press Release, "Virus engineered to express melanin offers new possibilities to diagnose and treat solid tumor cancers," Published on Feb. 11, 2013 [online][retrieved on Jul. 3, 2013] Retrieved from:<URL:genelux.com/february-11-2013/, 2 pages.

Genelux Press Release, "First patient treated in Genelux Phase I trial with GL-ONC1 at Memorial Sloan Kettering Cancer Center," Published on Feb. 5, 2013 [online][retrieved on Jul. 3, 2013] Retrieved from:<URL:genelux.com/february-05-2013/, 3 pages.

Genelux Press Release, "Genelux presents abstracts at the 7th international meeting on replicating oncolytic virus therapeutics in Quebec," Published on Jun. 15, 2013 [online][retrieved on Jul. 3, 2013] Retrieved from:<URL:genelux.com/june-15-2013/, 2 pages.

Genelux Press Release, "Industry veteran with more than 25 years experience will lead development and european commercialization and growth," Published on Jun. 27, 2013 [online][retrieved on Oct. 7, 2013] Retrieved from:<URL:genelux.com/june-27-2013/, 2 pages.

Genelux Press Release, "Genelux corporation presents abstracts at 2013 ASCO annual meeting for clinical trials of GL-ONC1, its oncolytic virus lead product candidate," Published on May 30, 2013 [online][retrieved on Jul. 3, 2013] Retrieved from:<URL:genelux.com/may-30-2013/, 2 pages.

Gholami et al., "Vaccinia virus GLV-1h153 in combination with 131I shows increased efficiency in treating triple-negative breast cancer," FASEB Journal, Published online before print Nov. 1, 2013 [article in press doi:10.1096/fj.13-237222], 7 pages (2013).

(56) References Cited

OTHER PUBLICATIONS

Gholami et al., "Vaccinia virus GLV-1h153 is a novel agent for detection and effective local control of positive surgical margins for breast cancer," Breast Cancer Res 15(2):R26, 11 pages (2013).
Haddad et al., "Imaging characteristics, tissue distribution, and spread of a novel oncolytic vaccinia virus carrying the human sodium iodide symporter," PLoS One. 7(8):e41647, 13 pages (2012).
Jun et al., "A novel oncolytic viral therapy and imaging technique for gastric cancer using a genetically engineered vaccinia virus carrying the human sodium iodide symporter," J Exp & Clin Cancer Res. 33:2, 7 pages (2014).
Khuri et al., "A controlled trial of intratumoral ONYX-015, a selectively-replicating adenovirus, in combination with cisplatin and 5-fluorouracil in patients wih recurrent head and neck cancer," Nature 6(8):879-885 (2000).
Kidokoro et al., "Genetically stable and fully effective smallpox vaccine strain constructed from highly attenuated vaccinia LC16m8," Proc. Natl. Acad. Sci. U.S.A. 102:4152-4157 (2005).
Lauer et al., "Phase I/II clinical trial of a genetically modified and oncolytic vaccinia virus GL-ONC1 in patients with unresactable, chemotherapy-resistant peritoneal carcinomatosis," Journal of Clinical Oncology, 2013 ASCO Annual Meeting Proceedings 31(15 Supple):3098 (2013).
Lin et al., "Treatment of anaplastic thyroid carcinoma in vitro with a mutant vaccinia virus," Presented at the 28th Annual Meeting of the American Association of Endocrine Surgeons, Tuscon, Arizona, Apr. 29 to May 1, 2007.
Lin et al., "Treatment of anaplastic thyroid carcinoma in vitro with a mutant vaccinia virus," Surgery 142(6):976-983 (2007).
Liu et al., "The Targeted oncolytic poxvirus JX-594 demonstrates antitumoral, antivascular, and anti-HBV activities in patients with hepatocellular carcinoma," Mol. Ther. 16(9):1637-1642 (2008).
Malhotra et al., "Use of an oncolytic virus secreting GM-CSF as combined oncolytic and immunotherapy for treatment of colorectal and hepatic adenocarcinomas," Surgery 141(4):520-529 (2007).
Morscher et al., "Imaging virus-mediated melanin production using multispectral optoacoustic tomography (MSOT)," British Society for Gene and Cell Therapy Conference Abstracts, P0015, Human Gene Therapy 24:A16(2013).
Nguyen et al., "Vaccinia virus-mediated expression of human erythropoietin in tumors enchances virotherapy and alleviates cancer-related anemia in mice," Mol Ther. 21(11):2054-2062 (2013).
Qin, H. and S. Chatterjee, "Cancer gene therapy using tumor cells infected with recombinant vaccinia virus expressing GM-CSF," Hum. Gene Ther. 7:1853-1860 (1996).
Reno, J., "Exclusive: Does San Diego biotech firm have a cure for cancer," Published on Jul. 17, 2013 [online][retrieved on Oct. 7, 2013] Retrieved from:<URL:therenodispatch.blogspot.com/2013/07/exclusive-does-san-diego-biotech-firm.html, 8 pages.
Schäfer et al., "Vaccinia virus-mediated intra-tumoral expression of matrix metalloproteinase 9 enhances oncolysis of PC-3 xenograft tumors," BMC Cancer 12(1):366, 20 pages (2012).
Stritzker, J. and A. Szalay, "Single-agent combinatorial cancer therapy," Proc. Natl. Acad. Sci. USA 110(21):8325-8326 (2013).

Stritzker et al., "Vaccinia virus-mediated melanin production allows MR and optoacoustic deep tissue imaging and laser-induced thermotherapy of cancer," Proc. Natl. Acad. Sci. 110(9):3316-3320 (2013).
Stroncek et al., "Highlights of the society for immunotherapy of cancer (SITC) 27th annual meeting," Journal for ImmunoTherapy of Cancer 1:4, 11 pages (2013).
Weibel et al., "Treatment of malignant effusion by oncolytic virotherapy in an experimental subcutaneous xenograft model of lung cancer," J. Transl. Med. 11:106 (2013).
Weibel et al., "Viral-mediated oncolysis is the most critical factor in the late-phase of the tumor regression process upon vaccinia virus infection," BMC Cancer 11:68 1-17 (2011).
Worschech et al., "Systemic treatment of xenografts with vaccinia virus GLV-1h68 reveals the immunologic facet of oncolytic therapy," BMC Genomics 10:301, 22 pages (2009).
Yu et al., "Oncolytic vaccinia therapy of squamous cell carcinoma," Mol. Cancer 8:45, 9 pages (2009).
Response to Office Action, submitted Apr. 23, 2013, in connection with corresponding U.S. Appl. No. 13/506,738, 26 pages.
Office Action, issued Jun. 12, 2013, in connection with corresponding U.S. Appl. No. 13/506,738, 8 pages.
Response to Office Action, submitted Dec. 12, 2013, in connection with corresponding U.S. Appl. No. 13/506,738, 17 pages.
Office Action, issued Feb. 6, 2014, in connection with corresponding U.S. Appl. No. 13/506,738, 5 pages.
Response to Office Action, submitted Mar. 27, 2014, in connection with corresponding U.S. Appl. No. 13/506,738, 13 pages.
Letter/Written Disclosure of the Information Disclosure Statement for the above-referenced application, mailed on Jul. 9, 2014, 2 pages.
Communication Pursuant to Article 94(3) EPC, issued Jun. 11, 2014, in connection with European Patent Application No. 08 768 418.9, 5 pages.
Letter/Written Disclosure of the Information Disclosure Statement for the above-referenced application, mailed on Jun. 9, 2014, 3 pages.
Eide, D.J., "The SLC39 family of metal ion transporters," Pflungers Arch—Eur. J. Physiol. 447:796-800 (2004).
Mackenzie et al., "Intracellular Iron Transport and Storage: From Molecular Mechanisms to Health Implications," Antioxidates & Redox Signaling 10(6):997-1030 (2008).
SLC5A1, page from Genetics Home, Published 2011 [online][retrieved on May 16, 2014] Retrieved from:<URL:ghr.nlm.nih.gov/gene/SLC5A1/show/print, 4 pages.
SLC6A8, page from Genetics Home, published 2011, accessed May 16, 2014, Retrieved from:<URL:ghr.nlm.nih.gov/gene/SLC6A8/show/print, 4 pages.
Solute Carrier Family, Wikipedia Entry, accessed Feb. 3, 2014, Retrieved from:<URL:ghr.nlm.nih.gov/gene/SLC6A8/show/print, 8 pages.
Notice of Allowance, issued May 23, 2014, in connection with U.S. Appl. No. 13/506,738, 9 pages.
Notice of Allowance, issued May 9, 2014, in connection with Canadian Patent Application No. 2,690,627, 2 pages.

* cited by examiner

MICROORGANISMS FOR IMAGING AND/OR TREATMENT OF TUMORS

RELATED APPLICATIONS

This application is a divisional of U.S. application Ser. No. 12/157,960, to Aladar A. Szalay, Nanhai Chen, Yong A. Yu, Qian Zhang, and Yuman Fong, filed on Jun. 13, 2008, entitled "MICROORGANISMS FOR IMAGING AND/OR TREATMENT OF TUMORS," which claims the benefit of priority under 35 U.S.C. §119(e) to U.S. Provisional Application Ser. No. 60/934,768, to Nanhai Chen, Yuman Fong, Aladar A. Szalay, Yong A. Yu and Qian Zhang, filed on Jun. 15, 2007, entitled "MICROORGANISMS FOR IMAGING AND/OR TREATMENT OF TUMORS." The subject matter of these applications are incorporated by reference in their entirety.

This application is related to International Application No. PCT/US2008/07377 to Nanhai Chen, Aladar A. Szalay, Yong A. Yu, Qian Zhang, and Yuman Fong, filed on Jun. 13, 2008, entitled "MICROORGANISMS FOR IMAGING AND/OR TREATMENT OF TUMORS," which also claims priority to U.S. Provisional Application Ser. No. 60/934,768. The subject matter of this application is incorporated by reference in its entirety.

Incorporation by Reference of a Sequence Listing Provided on Compact Discs

An electronic version on compact disc (CD-R) of the Sequence Listing is filed herewith in duplicate (labeled Copy #1 Replacement and Copy #2 Replacement), the contents of which are incorporated by reference in their entirety. The computer-readable file on each of the aforementioned compact discs, created on Apr. 1, 2010, is identical, 991 kilobytes in size, and entitled 112BSEQ.002.txt.

FIELD OF THE INVENTION

Modified recombinant viruses for diagnosis and therapy are provided. Diagnostic and therapeutic methods using the modified recombinant viruses also are provided.

BACKGROUND

Cancers, such as pancreatic cancer and malignant pleural mesothelioma, are highly aggressive diseases. The annual incidence in the United States was estimated to be ~40,000 cases for pancreatic cancer and ~4,000 cases for malignant mesothelioma in the year 2004, with increasing incidence worldwide for mesothelioma, especially in industrialized nations due to the etiology of this disease from asbestos exposure (Bianchi and Bianchi (2007) *Ind Health* 45: 379-87). Both of these tumors are highly resistant to standard therapies, with 5-year survival rates of only 5% for pancreatic cancer and 9% for mesothelioma. Even with combined surgery, chemotherapy and radiation, only a small minority of patients are rendered disease-free for a prolonged period of time (Adusumilli et al. (2006) *J Gene Med* 8:603-15.

Oncolytic viral therapy has been studied and tested over the past century, and many viral types, including adenovirus, herpes simplex virus, Newcastle disease virus, myxoma virus, vaccinia virus and vesicular stomatitis virus, are being investigated as novel agents for the treatment of human cancer (Woo et al. (2006) *Curr Opin Investig Drugs* 7:549-59). Accordingly, effective tumor diagnostic and therapeutic viral agents that are highly selective for tumors are needed. In addition, there exists a need to provide reagents and methods for tracking and monitoring viral distribution, tumor targeting, proliferation and persistence in oncolytic viral therapies by noninvasive imaging, which provide important safety, efficacy and toxicity data. Such real-time monitoring also would provide useful viral-dose and administration schedule information for optimization of therapy and would obviate the need for multiple and repeated tissue biopsies.

SUMMARY

Provided are recombinant viruses, particularly, vaccinia virus, such as LIVP, that accumulates in tumors or other immunoprivileged tissues, such as wounds and inflamed tissues, and not accumulate to toxic levels in other tissues. These viruses encoded a protein that enhances uptake or retention of a compound that emits a signal that permits detection, such as by non-optical imaging. Proteins that enhance uptake or retention include transporter proteins. These viruses also can be used for treatment of tumors, wounded tissues and inflammations within a subject. The compound that is taken up or retained can be a therapeutic compound or can be modified, such as by conjugate to a therapeutic compound, to have therapeutic activity. The viruses can be used for detection, detection and treatment, detection and monitoring of treatment. Methods for detection, detection and treatment, detection and monitoring of treatment are provided as are uses of recombinant viruses, such as vaccinia viruses for detection, detection and treatment, detection and monitoring of treatment.

Provided herein are recombinant vaccinia viruses that encode a sodium-dependent transporter protein. Sodium-dependent transporter proteins include those from the solute carrier 5 and solute carrier 6 transporter protein families, such as a norepinephrine transporter (NET) and a sodium-iodide symporter (NIS), including a human norepinephrine transporter (hNET) and a human sodium-iodide symporter (hNIS) as well as allelic and species variants thereof and other variants, including any having at least about or at least 60, 65, 70, 75, 80, 85, 88, 90, 91, 92, 93, 94, 95, 96, 97, 98 and 99 percent or more sequence identity with those disclosed herein. These include modified forms that retain transporter activity sufficient for the methods provided herein.

Recombinant vaccinia virus include of any of claims 1-5 that is a Lister strain viruses, such as the LIVP strain. Nucleic acid encoding transporter protein can be inserted anywhere in the virus such that the virus expresses it and replicates in a subject. In exemplary embodiments, the nucleic acid encoding the transporter protein is inserted into a nonessential locus or gene, such as the hemagglutinin (HA), thymidine kinase (TK) or F14.5 gene or locus. Exemplary of such viruses are those provided herein that include GLV-1h99, GLV-1h100, GLV-1h101, GLV-1h139, GLV-1h146, GLV-1h150, GLV-1h151, GLV-1h152 and GLV-1h153. These viruses can be further modified to encode a therapeutic protein. Generally the encoding nucleic acid is inserted into a different locus from the nucleic acid that encodes the transporter protein. Exemplary therapeutic agents include, but are not limited to an anti-cancer agents and anti-angiogenic agents. A therapeutic agent, includes, but is not limited to, a cytokine, a chemokine, an immunomodulatory molecule, an antigen, an antibody or fragment thereof, antisense RNA, prodrug converting enzyme, siRNA, angiogenesis inhibitor, a toxin, an antitumor oligopeptide, a mitosis inhibitor protein, an antimitotic oligopeptide, an anti-cancer polypeptide antibiotic, and tissue factor, such as single chain antibody (scFv), including an anti-VEGF single chain antibody, a plasminogen K5 domain, a human tissue factor-αvβ3-integrin RGD fusion protein, interleukin-24 or an IL-6-IL-6 receptor fusion protein and fusion proteins of substrates for the transporter protein and a therapeutic agent, such as a chemotherapeutic compound or a toxin. The viruses can encode a plurality of therapeutic agents and/or transporter proteins.

Also provided are combination that contain one or more of the recombinant viruses, particularly vaccinia viruses, provided herein, and a substrate transported into a cell that expresses the transporter; and/or an anti-cancer compound. Substrates can be detectable or can induce a detectable signal or can modified to be detectable or to induce a detectable signal, such as electromagnetic radiation. The substrate can be radiolabeled; it can be conjugated to a cytotoxic agent, such as a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anti-cancer antibody, an anti-cancer antibiotic, an immunotherapeutic agent, a bacterium and combinations thereof.

Conjugation can be chemical or, where the substrate and cytotoxic agent are proteins can be a fusion protein. Conjugate can be direct or via a linker. Exemplary cytotoxic agents, include, but are not limited to, radiolabels, a cytotoxins and chemotherapeutic drugs and cytotoxic drugs. Exemplary cytotoxic agents, include, but are not limited to, double-chain ricin, ricin A chain, abrin, abrin A chain, saporin, modeccin, modeccin A chain, *Pseudomonas aeruginosa* exotoxin, *Cholera* toxin, *Shigella* toxin, *E. coli* heat labile toxin and *Diphtheria* toxin, doxorubicin, daunomycin, 5-fluorouracil, methotrexate, taxol, ricin A, colchicine, cytochasins, monensin, ouabain, mitoxanthrone, vindesine, vinblastine, vincristine, enterotoxin, cisplatin, carboplatin, gemcitabine, irinotecan, an anti-EGFR antibody and an anti-VEGF antibody. In addition to conjugation the substrate and cytotoxic agent can be separate and can be separately administered. *Proteinaceous* cytotoxic agents and conjugates also can be expressed by the virus. In the combinations, the substrate and virus can be formulated as a single composition or separately in two compositions. Also, provided are kits that contain the combinations and optionally reagents and other components for use of the combinations and instructions for use thereof.

Also provided are pharmaceutical composition containing the recombinant viruses provided herein in a pharmaceutically acceptable carrier. They can be formulated for any type of administration including local or systemic administration.

The recombinant viruses provided herein also can be vaccines, including smallpox vaccines.

Also provided are methods of imaging or detecting a tumor, an inflammation or a wound within a subject practiced by administering any virus provided herein to a subject suspected of a having a tumor and/or internal wound or inflammation. In practicing the method, the virus is administered with or sequentially or intermittently with a substrate that is transported into a cell that expresses the transporter encoded by the virus. The substrate or its accumulation can be detected, thereby detecting or imaging a tumor, wound and/or inflammation. Detection and imaging can be effected by fluorescence imaging, magnetic resonance imaging (MRI), single-photon emission computed tomography (SPECT), positron emission tomography (PET), scintigraphy, gamma camera, a β+ detector, a γ detector and combinations thereof.

Methods of treatment are provided. The methods are effected by administering any virus provided herein to a subject to effect treatment. Treatment can be for any disease or disorder for which administration of a virus, particularly a vaccinia virus, is effective. Such diseases and disorders include, tumors and cancers and/or metastasis. The method can further include administering a substrate that is transported into a cell that expresses the transporter encoded by the virus. The substrate itself can be therapeutic or it can be conjugated to a therapeutic agent, whereby treatment is effected. The substrate can be administered before or after or simultaneously with the virus or it can be encoded by nucleic acid that is administered, such as another virus or other vector that encodes it. The substrate can be conjugated to a cytotoxic agent as described above.

For the methods of treatment, the virus can be administered by any suitable route, including systemically, intravenously, intraarterially, intratumorally, endoscopically, intralesionally, intramuscularly, intradermally, intraperitoneally, intravesicularly, intraarticularly, intrapleurally, percutaneously, subcutaneously, orally, parenterally, mucosally, intranasally, intratracheally, by inhalation, intracranially, intraprostaticaly, intravitreally, topically, ocularly, vaginally and rectally. The virus or virus and substrate can be administered with an anticancer agent or treatment. The anticancer agent or treatment can be administered before or after or simultaneously or intermittently with the virus or the virus and substrate. Anti-cancer agents include any noted above, including, but not limited to, a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anti-cancer antibody, an anti-cancer antibiotic, an immunotherapeutic agent, hyperthermia or hyperthermia therapy, a bacterium, radiation therapy and any combination thereof.

Exemplary anticancer agents include cisplatin, carboplatin, gemcitabine, irinotecan, an anti-EGFR antibody and an anti-VEGF antibody. Exemplary anticancer therapies include radiation. Treatments with anticancer agents or therapies, can be effected simultaneously or intermittently with the virus or with the virus and/or substrate in any order. The virus and substrate and anticancer agent can be administered separately or can be combined into one or two compositions. Thus, the virus and the anticancer agent can be administered as a single composition or as two compositions, or the virus, substrate and anticancer agent can be administered in a single composition or in two compositions containing two of the substrate, virus and anticancer agent, or in three compositions.

Tumors that can be treated by administration of the virus, or virus and substrate or virus, substrate and anticancer agent or therapy, include, but are not limited to a bladder tumor, breast tumor, prostate tumor, carcinoma, basal cell carcinoma, biliary tract cancer, bladder cancer, bone cancer, brain cancer, CNS cancer, glioma tumor, cervical cancer, choriocarcinoma, colon and rectum cancer, connective tissue cancer, cancer of the digestive system, endometrial cancer, esophageal cancer, eye cancer, cancer of the head and neck, gastric cancer, intra-epithelial neoplasm, kidney cancer, larynx cancer, leukemia, liver cancer, lung cancer, lymphoma, Hodgkin's lymphoma, Non-Hodgkin's lymphoma, melanoma, myeloma, neuroblastoma, oral cavity cancer, ovarian cancer, pancreatic cancer, retinoblastoma, rhabdomyosarcoma, rectal cancer, renal cancer, cancer of the respiratory system, sarcoma, skin cancer, stomach cancer, testicular cancer, thyroid cancer, uterine cancer, and cancer of the urinary system, such as lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, small cell lung cancer, non small cell lung cancers, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma, granulocytic sarcoma, corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma, cystadenoma, follicular lymphoma, intestinal lymphosarcoma, fibrosarcoma, and pulmonary squamous cell carcinoma, leukemia, hemangiopericytoma, ocular neoplasia, preputial fibrosarcoma, ulcerative squamous cell carcinoma, preputial carcinoma, connective tissue neoplasia, mastocytoma, hepatocellular carcinoma, lymphoma, pulmonary adenomatosis, pulmonary sarcoma, Rous sarcoma, reticulo-endotheliosis, fibrosarcoma, nephroblastoma, B-cell lymphoma, lymphoid leukosis, retinoblastoma, hepatic neoplasia, lymphosarcoma, plasmacytoid leukemia, swimbladder sarcoma (in fish), caseous lumphadenitis, lung carcinoma, insulinoma, lymphoma, sarcoma, neuroma, pancreatic islet cell tumor, gastric MALT lymphoma and gastric adenocarcinoma.

An antiviral agent can be administered simultaneously or sequentially with any of the above-treatments. Anti-viral agents, include, but are not limited to, cidofovir, alkoxyalkyl esters of cidofovir, GLEEVEC, gancyclovir, acyclovir and ST-246.

Methods of treatment and detection are provided. The virus or virus and anti-cancer agent or therapy can be administered sequentially or simultaneously with a detectable substrate or a substrate that induces a signal and that is transported into a cell that expresses the transporter encoded by the virus; and then the substrate or accumulation of the substrate is detected. Thus, treatment and detection can be effected. Detection, which includes imaging, can be used to monitor treatment, particularly, if detection is effected a plurality of times to monitor the changes in the pattern of accumulation of a substrate. Effective treatment would result in less accumulation of substrate or a more localized accumulation or other pattern correlated with a decrease in tumor size or metastasis or other indicator of tumor treatment.

In practicing the methods of treatment or treatment and detection, the virus can encode a therapeutic agent, such as an anti-tumor therapeutic agent. Inclusion of such agent is optional as the viruses, particularly the vaccinia viruses provided herein, effect treatment in the absence of further therapeutic agent.

Also provided are cells, particularly isolated cells, including tumor cells, that contain any virus provided herein. The cells can be provided in pharmaceutical compositions for treatment. Uses of the virus provided herein for treatment of or for the preparation of a pharmaceutical composition for the treatment of cancer or detection of cancer, tumors, metastases, wound and/or inflammation in a subject are provided. Also compositions containing the viruses for such uses are provided. The compositions and uses can include a substrate or conjugate containing the substrate that can be transported into a cell that expresses the transporter protein encoded by the virus. The compositions optionally can include an anti-cancer compound in addition to the virus and/or substrate or conjugate as described above. Anticancer compound include any noted herein, including, but are not limited to, a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anti-cancer antibody, an anti-cancer antibiotic, an immunotherapeutic agent, hyperthermia or hyperthermia therapy, a bacterium and combinations thereof, such as cisplatin, carboplatin, gemcitabine, irinotecan, an anti-EGFR antibody and an anti-VEGF antibody.

DETAILED DESCRIPTION

Outline
  A. Definitions
  B. Viruses for treatment and diagnosis
  C. Transporter Proteins
    1. The sodium- and chloride-dependent neurotransmitter transporter family
      a. Norepinephrine Transporter
        i. Structure
        ii. Function
    2. The sodium glucose cotransporter family
      a. Sodium Iodide Symporter
        i. Structure
        ii. Function
  D. Methods of assessing modified viruses encoding transporters
    1. In vitro assessment
    2. In vivo assessment
    3. Selection of substrates
  E. Additional modifications of viruses provided
    1. Modification of viral genes
    2. Expression of additional heterologous genes
      a. Detectable gene product
      b. Therapeutic gene product
      c. Superantigen
      d. Gene product to be harvested
      e. Control of heterologous gene expression
  F. Methods for making a modified virus
    1. Genetic modifications
    2. Screening of modified viruses
  G. Exemplary characteristics of the viruses provided
    1. Attenuated
      a. Reduced toxicity
      b. Accumulate in tumor, not substantially in other organs
      c. Ability to elicit or enhance immune response to tumor cells
      d. Balance of pathogenicity and release of tumor antigens
    2. Immunogenicity
    3. Replication competent
    4. Genetic variants
  H. Pharmaceutical Compositions, combinations and kits
    1. Pharmaceutical compositions
    2. Host cells
    3. Combinations
    4. Kits
  I. Diagnostic and Therapeutic Methods
    1. Administration
      a. Steps prior to administering the virus
      b. Mode of administration
      c. Dosages
      d. Number of administrations
      e. Co-administrations
        i. Administering a plurality of viruses
        ii. Therapeutic Compounds
        iii. Immunotherapies and biological therapies
      f. State of subject 2. Monitoring
   a. Monitoring viral gene expression
   b. Monitoring tumor size
   c. Monitoring antibody titer
   d. Monitoring general health diagnostics
   e. Monitoring coordinated with treatment
K. Other microorganisms and cells
L. Examples A. Definitions Unless defined otherwise, all technical and scientific terms used herein have the same meaning as is commonly understood by one of skill in the art to which the invention(s) belong. All patents, patent applications, published applications and publications, websites and other published materials referred to throughout the entire disclosure herein, unless noted otherwise, are incorporated by reference in their entirety. In the event that there are pluralities of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, a "transporter" is a membrane transport protein. Transporters are involved in the movement of ions, small molecules, or macromolecules, such as other proteins, across a biological membrane. Transporters can be located on the outer cell membrane or membrane-bound intracellular compartments such as the nucleus, endoplasmic reticulum, and mitochondria. Transporters typically show relatively high specificity for one or more substrates and can transport solutes against their chemical or electrochemical potential gradient. They can either function without input of energy beyond the thermal movement (facilitated or mediated diffusion), or be driven by electrochemical potential gradients of $H^+$ and $Na^+$, or by various exergonic chemical and photochemical reactions. Reference to transporters includes any protein, allelic and species variants thereof and any other variants thereof, that can be classified as a transporter using the Transport Classification (TC) system (Saier et al., (2006) Nucleic Acids Research 34(Database Issue):D181-D186). Such proteins are easily identified using, for example, public databases such as the Transport Classification Database (TCDB; www.tcdb.org).

As used herein, a "symporter" is a transporter that moves two chemical species in the same direction, at least one of them being ionic and driven by its electrochemical potential gradient.

As used herein, norepinephrine transporter or NET refers to the sodium- and chloride-dependent neurotransmitter symporter that removes norepinephrine (NE) from the extracellular space by high affinity reuptake into presynaptic terminals. NET also is referred to as the "sodium-dependent noradrenaline transporter," "noradrenaline:$Na^+$ symporter," "SLC6A2," "TC 2.A.22.1.2" and "solute carrier family 6 (neurotransmitter transporter, noradrenalin), member 2." NET is a member of the sodium- and chloride-dependent neurotransmitter transporter family (Solute carrier family 6; SLC6), also known as the sodium/neurotransmitter symporter family (SNF) or the neurotransmitter/sodium symporter family (NSS), which corresponds to TC 2.A.22 using the TC system. Norepinephrine transporters include those of human origin (hNET) and non-human origin. Exemplary non-human norepinephrine transporters include, but are not limited to, bovine (SEQ ID NO:27), mouse (SEQ ID NO:28), rat (SEQ ID NO:29), rhesus macaque (SEQ ID NO:30), chicken (SEQ ID NO:31), ovine (fragment) (SEQ ID NO:32) and Japanese quail (fragment) (SEQ ID NO:33) norepinephrine transporters.

As used herein, hNET refers to the human norepinephrine transporter. Exemplary hNETs include the wildtype hNET set forth in SEQ ID NO:26, C-terminal variants (SEQ ID NOS: 61 and 62), allelic variants (SEQ ID NOS:45-60) and any other variants thereof, including any variants known in the art, including polypeptides that have at least 40%, 45%, 50%, 55%, 65%, 70%, 75%, 80%, 85%, 90%, 95%, 96%, 97%, 98%, 99% or more sequence identity to the polypeptide set forth in SEQ ID NO: 26.

Reference to norepinephrine transporters or NETs includes wildtype polypeptides, truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the polypeptide set forth in SEQ ID NO: 26 or the mature form thereof. Norepinephrine transporters also include those that contain chemical or posttranslational modifications and those that do not contain chemical or posttranslational modifications. Such modifications include, but are not limited to, pegylation, albumination, glycosylation, farnysylation, carboxylation, hydroxylation, phosphorylation, and other polypeptide modifications known in the art. Reference to norepinephrine transporters also can include fusion proteins containing a norepinephrine transporter or portion thereof that retains activity.

As used herein, sodium-iodide symporter or NIS is an ion pump that transports iodide ($I^-$) into thyroid epithelial cells and other select cells across the basolateral plasma membrane. NIS also is referred to as the "Sodium/iodide cotransporter," "Na(+)/I(−) cotransporter," "SLC5A5," "TC 2.A.21.5.1" and "solute carrier family 5 member 5." NIS is a member of the sodium glucose cotransporter family (Solute carrier family 5; SLC5), also known as the sodium/solute symporter family (SSSF) or TC 2.A.21 using the TC system. Sodium-iodide symporters include those of human origin (hNIS) and non-human origin. Exemplary non-human sodium-iodide symporters include, but are not limited to, mouse (SEQ ID NO:65), rat (SEQ ID NO:66), Zebrafish (SEQ ID NOS:67), and African clawed frog mouse (SEQ ID NO:68) sodium-iodide symporters.

As used herein, hNIS refers to the human sodium-iodide symporter. Exemplary hNETs include the wildtype hNIS set forth in SEQ ID NO:63, allelic variants (SEQ ID NOS:87-94) and any other variants thereof, including any variants known in the art (see e.g. International Patent Publication WO2004000236), and includes polypeptides that have at least 40%, 45%, 50%, 55%, 65%, 70%, 75%, 80%, 85%, 90%, 95%, 96%, 97%, 98%, 99% or more sequence identity to the polypeptide set forth in SEQ ID NO: 63.

Reference to sodium-iodide symporters or NISs includes wildtype polypeptides, truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the polypeptide set forth in SEQ ID NO: 63 or the mature form thereof. Sodium-iodide symporters also include those that contain chemical or posttranslational modifications and those that do not contain chemical or posttranslational modifications. Such modifications include, but are not limited to, pegylation, albumination, glycosylation, farnysylation, carboxylation, hydroxylation, phosphorylation, and other polypeptide modifications known in the art. Reference to sodium-iodide symporters also can include fusion proteins containing a sodium-iodide symporters or portion thereof that retains activity.

As used herein, "virus" refers to any of a large group of entities referred to as viruses. Viruses typically contain a protein coat surrounding an RNA or DNA core of genetic material, but no semipermeable membrane, and are capable of growth and multiplication only in living cells. Viruses for use in the methods provided herein include, but are not limited, to a poxvirus, adenovirus, herpes simplex virus, Newcastle disease virus, vesicular stomatitis virus, mumps virus, influenza virus, measles virus, reovirus, human immunodeficiency virus (HIV), hanta virus, myxoma virus, cytomegalovirus (CMV), lentivirus, and any plant or insect virus.

As used herein, the term "viral vector" is used according to its art-recognized meaning. It refers to a nucleic acid vector construct that includes at least one element of viral origin and can be packaged into a viral vector particle. The viral vector particles can be used for the purpose of transferring DNA, RNA or other nucleic acids into cells either in vitro or in vivo. Viral vectors include, but are not limited to, retroviral vectors, vaccinia vectors, lentiviral vectors, herpes virus vectors (e.g., HSV), baculoviral vectors, cytomegalovirus (CMV) vectors, papillomavirus vectors, simian virus (SV40) vectors, semliki forest virus vectors, phage vectors, adenoviral vectors, and adeno-associated viral (AAV) vectors.

As used herein, the term "modified" with reference to a gene refers to a deleted gene, a gene encoding a gene product having one or more truncations, mutations, insertions or deletions, or a gene that is inserted (into the chromosome or on a plasmid, phagemid, cosmid, and phage) encoding a gene product, typically accompanied by at least a change in function of the modified gene product or virus.

As used herein, the term "modified virus" refers to a virus that is altered with respect to a parental strain of the virus. Typically modified viruses have one or more truncations, mutations, insertions or deletions in the genome of virus. A modified virus can have one or more endogenous viral genes modified and/or one or more intergenic regions modified. Exemplary modified viruses can have one or more heterologous nucleic acid sequences inserted into the genome of the virus. Modified viruses can contain one more heterologous nucleic acid sequences in the form of a gene expression cassette for the expression of a heterologous gene.

As used herein, modification of a heterologous nucleic acid molecule with respect to a virus containing a heterologous nucleic acid molecule refers to any alteration of the heterologous nucleic acid molecule including truncations, mutations, insertions or deletions of the nucleic acid molecule. A deletion in a heterologous nucleic acid molecule can include all or a portion of the heterologous nucleic acid molecule. For example, if the heterologous nucleic acid molecule is a double stranded DNA molecule that is 5,000 base pairs in length, deletions of the heterologous nucleic acid molecule can include deletions of 1, 2, 3, 4, 5 or more, 10 or more, 50 or more, 100 or more, 500 or more, 1,000 or more, or 5,000 base pairs of the heterologous nucleic acid molecule. Deletion of all or a part of the nucleic acid molecule can also include replacement of the heterologous nucleic acid molecule with another nucleic acid molecule. Modification of a heterologous nucleic acid molecule can also include alteration of the viral genome. For example, a deletion of all or a portion heterologous nucleic from the viral genome, for example by homologous recombination, can also include deletion of nucleic acid surrounding the deletion site that is part of the viral genome. Similarly, insertion of an additional heterologous nucleic acid molecule into the viral genome by homologous recombination, for example, can include deletion or all, or a part of a viral gene. When modification of a heterologous nucleic acid molecule is an insertion, an additional nucleic acid molecule can be inserted in the heterologous nucleic acid molecule or adjacent to the nucleic acid molecule. Typically, insertions by homologous recombination involve replacement of all or a part of the heterologous nucleic acid molecule with another nucleic acid molecule.

As used herein, the term "therapeutic virus" refers to a virus that is administered for the treatment of a disease or disorder, such as cancer, a tumor and/or a metastasis or inflammation or wound or diagnosis thereof and or both. A therapeutic virus typically is modified, such as to attenuate it. Other modifications include one or more insertions, deletions or mutations in the genome of the virus. Therapeutic viruses all can include modifications in one or more endogenous viral genes or one or more intergenic regions, which attenuate the toxicity of the virus, and can optionally express a heterologous therapeutic gene product and/or detectable protein. Therapeutic viruses can contain heterologous nucleic acid molecules, including one or more gene expression cassettes for the expression of the therapeutic gene product and/or detectable protein. Therapeutic viruses can be replication competent viruses (e.g., oncolytic viruses) or replication-defective viruses.

As used herein, a virus that can be detected and used for diagnostics and is therapeutic is a theragnostic virus.

As used herein, the term, "therapeutic gene product" or "therapeutic polypeptide" refers to any heterologous protein expressed by the therapeutic virus that ameliorates the symptoms of a disease or disorder or ameliorates the disease or disorder.

As used herein, the phrase "immunoprivileged cells and tissues" refers to cells and tissues, such as solid tumors and wounded tissues, which are sequestered from the immune system.

As used herein, preferential accumulation refers to accumulation of a virus at a first location at a higher level than accumulation at a second location. Thus, a virus that preferentially accumulates in immunoprivileged tissue, such as a tumor, relative to normal tissues or organs refers to a virus that accumulates in immunoprivileged tissue, such as tumor, at a higher level, or concentration, than the virus accumulates in normal tissues or organs.

As used herein, to attenuate toxicity of a virus means to reduce or eliminate deleterious or toxic effects to a host upon administration of the virus compared to an un-attenuated virus. As used herein, a virus with low toxicity means that upon administration a virus does not accumulate in organs and tissues in the host to an extent that results in damage or harm to organs, or that impacts survival of the host to a greater extent than the disease being treated does. For the purposes herein, attenuation of toxicity is used interchangeably with attenuation of virulence and attenuation of pathogenicity.

As used herein, the term "toxicity" with reference to a virus refers to the ability of the virus to cause harm to the subject to which the virus has been administered.

As used herein virulence and pathogenicity with reference to a virus refers to the ability of the virus to cause disease or harm in the subject to which the virus has been administered. Hence, for the purposes herein the terms toxicity, virulence and pathogenicity with reference to a virus are used interchangeably.

As used herein, a compound produced in a tumor or other immunoprivileged site refers to any compound that is produced in the tumor or tumor environment by virtue of the presence of an introduced virus, generally a recombinant virus, expressing one or more gene products. For example, a compound produced in a tumor can be, for example, an encoded polypeptide, such as a recombinant polypeptide (e.g., a transporter, a cell-surface receptor, a cytokine, a chemokine, an apoptotic protein, a mitosis inhibitor protein, an antimitotic oligopeptide, an antiangiogenic factor, a single-chain antibody, a toxin, a tumor antigen, a prodrug converting enzyme), an RNA (e.g., ribozyme, RNAi, siRNA), or a compound that is generated by an encoded polypeptide and, in some examples, the cellular machinery of the tumor or immunoprivileged tissue or cells (e.g., a metabolite, a converted prodrug).

As used herein, a delivery vehicle for administration refers to a lipid-based or other polymer-based composition, such as liposome, micelle or reverse micelle, which associates with an agent, such as a virus provided herein, for delivery into a host animal.

As used herein, a disease or disorder refers to a pathological condition in an organism resulting from, for example, infection or genetic defect, and characterized by identifiable symptoms.

As used herein, treatment means any manner in which the symptoms of a condition, disorder or disease are ameliorated or otherwise beneficially altered. Treatment also encompasses any pharmaceutical use of the viruses described and provided herein.

As used herein, amelioration or alleviation of the symptoms of a particular disorder, such as by administration of a particular pharmaceutical composition, refers to any lessening, whether permanent or temporary, lasting or transient that can be attributed to or associated with administration of the composition.

As used herein, an effective amount of a virus or compound for treating a particular disease is an amount that is sufficient to ameliorate, or in some manner reduce the symptoms associated with the disease. Such an amount can be administered as a single dosage or can be administered according to a regimen, whereby it is effective. The amount can cure the disease but, typically, is administered in order to ameliorate the symptoms of the disease. Repeated administration can be required to achieve the desired amelioration of symptoms.

As used herein, an in vivo method refers to a method performed within the living body of a subject.

As used herein, a subject includes any animal for whom diagnosis, screening, monitoring or treatment is contemplated. Animals include mammals such as primates and domesticated animals. An exemplary primate is human. A patient refers to a subject such as a mammal, primate, human, or livestock subject afflicted with a disease condition or for which a disease condition is to be determined or risk of a disease condition is to be determined.

As used herein, the term "neoplasm" or "neoplasia" refers to abnormal new cell growth, and thus means the same as tumor, which can be benign or malignant. Unlike hyperplasia, neoplastic proliferation persists even in the absence of the original stimulus.

As used herein, neoplastic disease refers to any disorder involving cancer, including tumor development, growth, metastasis and progression.

As used herein, cancer is a term for diseases caused by or characterized by any type of malignant tumor, including metastatic cancers, lymphatic tumors, and blood cancers. Exemplary cancers include, but are not limited to: leukemia, lymphoma, pancreatic cancer, lung cancer, ovarian cancer, breast cancer, cervical cancer, bladder cancer, prostate cancer, glioma tumors, adenocarcinomas, liver cancer and skin cancer. Exemplary cancers in humans include a bladder tumor, breast tumor, prostate tumor, basal cell carcinoma, biliary tract cancer, bladder cancer, bone cancer, brain and CNS cancer (e.g., glioma tumor), cervical cancer, choriocarcinoma, colon and rectum cancer, connective tissue cancer, cancer of the digestive system; endometrial cancer, esophageal cancer; eye cancer; cancer of the head and neck; gastric cancer; intra-epithelial neoplasm; kidney cancer; larynx cancer; leukemia; liver cancer; lung cancer (e.g. small cell and non-small cell); lymphoma including Hodgkin's and Non-Hodgkin's lymphoma; melanoma; myeloma, neuroblastoma, oral cavity cancer (e.g., lip, tongue, mouth, and pharynx); ovarian cancer; pancreatic cancer, retinoblastoma; rhabdomyosarcoma; rectal cancer, renal cancer, cancer of the respiratory system; sarcoma, skin cancer; stomach cancer, testicular cancer, thyroid cancer; uterine cancer, cancer of the urinary system, as well as other carcinomas and sarcomas. Malignant disorders commonly diagnosed in dogs, cats, and other pets include, but are not limited to, lymphosarcoma, osteosarcoma, mammary tumors, mastocytoma, brain tumor, melanoma, adenosquamous carcinoma, carcinoid lung tumor, bronchial gland tumor, bronchiolar adenocarcinoma, fibroma, myxochondroma, pulmonary sarcoma, neurosarcoma, osteoma, papilloma, retinoblastoma, Ewing's sarcoma, Wilm's tumor, Burkitt's lymphoma, microglioma, neuroblastoma, osteoclastoma, oral neoplasia, fibrosarcoma, osteosarcoma and rhabdomyosarcoma, genital squamous cell carcinoma, transmissible venereal tumor, testicular tumor, seminoma, Sertoli cell tumor, hemangiopericytoma, histiocytoma, chloroma (e.g., granulocytic sarcoma), corneal papilloma, corneal squamous cell carcinoma, hemangiosarcoma, pleural mesothelioma, basal cell tumor, thymoma, stomach tumor, adrenal gland carcinoma, oral papillomatosis, hemangioendothelioma and cystadenoma, follicular lymphoma, intestinal lymphosarcoma, fibrosarcoma and pulmonary squamous cell carcinoma. In rodents, such as a ferret, exemplary cancers include insulinoma, lymphoma, sarcoma, neuroma, pancreatic islet cell tumor, gastric MALT lymphoma and gastric adenocarcinoma. Neoplasias affecting agricultural livestock include leukemia, hemangiopericytoma and bovine ocular neoplasia (in cattle); preputial fibrosarcoma, ulcerative squamous cell carcinoma, preputial carcinoma, connective tissue neoplasia and mastocytoma (in horses); hepatocellular carcinoma (in swine); lymphoma and pulmonary adenomatosis (in sheep); pulmonary sarcoma, lymphoma, Rous sarcoma, reticulo-endotheliosis, fibrosarcoma, nephroblastoma, B-cell lymphoma and lymphoid leukosis (in avian species); retinoblastoma, hepatic neoplasia, lymphosarcoma (lymphoblastic lymphoma), plasmacytoid leukemia and swimbladder sarcoma (in fish), caseous lumphadenitis (CLA): chronic, infectious, contagious disease of sheep and goats caused by the bacterium Corynebacterium pseudotuberculosis, and contagious lung tumor of sheep caused by jaagsiekte.

As used herein, the term "malignant," as it applies to tumors, refers to primary tumors that have the capacity of metastasis with loss of growth control and positional control.

As used herein, metastasis refers to a growth of abnormal or neoplastic cells distant from the site primarily involved by the morbid process.

As used herein, proliferative disorders include any disorders involving abnormal proliferation of cells, such as, but not limited to, neoplastic diseases.

As used herein, a method for treating or preventing neoplastic disease means that any of the symptoms, such as the tumor, metastasis thereof, the vascularization of the tumors or other parameters by which the disease is characterized are reduced, ameliorated, prevented, placed in a state of remission, or maintained in a state of remission. It also means that the indications of neoplastic disease and metastasis can be eliminated, reduced or prevented by the treatment. Non-limiting examples of the indications include uncontrolled degradation of the basement membrane and proximal extracellular matrix, migration, division, and organization of the endothelial cells into new functioning capillaries, and the persistence of such functioning capillaries.

As used herein, the term "angiogenesis" is intended to encompass the totality of processes directly or indirectly involved in the establishment and maintenance of new vasculature (neovascularization), including, but not limited to, neovascularization associated with tumors and neovascularization associated with wounds.

As used herein, therapeutic agents are agents that ameliorate the symptoms of a disease or disorder or ameliorate the disease or disorder. Therapeutic agent, therapeutic compound, therapeutic regimen, or chemotherapeutic include conventional drugs and drug therapies, including vaccines, which are known to those skilled in the art and described elsewhere herein. Therapeutic agents include, but are not limited to, moieties that inhibit cell growth or promote cell death, that can be activated to inhibit cell growth or promote cell death, or that activate another agent to inhibit cell growth or promote cell death. Optionally, the therapeutic agent can exhibit or manifest additional properties, such as, properties that permit its use as an imaging agent, as described elsewhere herein. Therapeutic agents for the compositions, methods and uses provided herein can be, for example, an anti-cancer agent. Exemplary therapeutic agents include, for example, cytokines, growth factors, photosensitizing agents, radionuclides, toxins, anti-metabolites, signaling modulators, anti-cancer antibiotics, anti-cancer antibodies, angiogenesis inhibitors, radiation therapy, chemotherapeutic compounds or a combination thereof.

As used herein, anti-cancer agents (used interchangeably with "anti-tumor or anti-neoplastic" agent) include any anti-cancer therapies, such as radiation therapy, surgery, hyperthermia or hyperthermia therapy, or anti-cancer compounds useful in the treatment of cancer. These include any agents, when used alone or in combination with other agent, that can alleviate, reduce, ameliorate, prevent, or place or maintain in a state of remission of clinical symptoms or diagnostic markers associated with neoplastic disease, tumors and cancer, and can be used in methods, combinations and compositions provided herein. Exemplary anti-cancer agents include, but are not limited to, the viruses provided herein used singly or in combination and/or in combination with other anti-cancer agents. Exemplary anti-cancer compounds include cytokines, chemokines, growth factors, a photosensitizing agents, toxins, anti-cancer antibiotics, chemotherapeutic compounds, radionuclides, angiogenesis inhibitors, signaling modulators, anti-metabolites, anti-cancer vaccines, anti-cancer oligopeptides, mitosis inhibitor proteins, antimitotic oligopeptides, anti-cancer antibodies (e.g., single-chain antibodies), anti-cancer antibiotics, immunotherapeutic agents, bacteria and any combinations thereof.

Exemplary cytokines and growth factors include, but are not limited to, interleukins, such as, for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factors (GM-CSF), angiogenins, and tissue factors.

Photosensitizing agents include, but are not limited to, for example, indocyanine green, toluidine blue, aminolevulinic acid, texaphyrins, benzoporphyrins, phenothiazines, phthalocyanines, porphyrins such as sodium porfimer, chlorins such as tetra(m-hydroxyphenyl)chlorin or tin(IV) chlorin e6, purpurins such as tin ethyl etiopurpurin, purpurinimides, bacteriochlorins, pheophorbides, pyropheophorbides or cationic dyes.

Radionuclides, which depending upon the radionuclide, amount and application can be used for diagnosis and/or for treatment. They include, but are not limited to, for example, a compound or molecule containing $^{11}$Carbon, $^{11}$Fluorine, $^{13}$Carbon, $^{15}$Nitrogen, $^{18}$Fluorine, $^{19}$Fluorine, $^{32}$Phosphate, $^{60}$Cobalt, $^{90}$Yttirum, $^{99}$Technetium, $^{103}$Palladium, $^{106}$Ruthenium, $^{111}$Indium, $^{117}$Lutetium, $^{125}$Iodine, $^{131}$Iodine, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth or $^{213}$Bismuth.

Toxins include, but are not limited to, chemotherapeutic compounds such as, but not limited to, 5-fluorouridine, calicheamicin, maytansine, double-chain ricin, ricin A chain, abrin, abrin A chain, saporin, modeccin, modeccin A chain, *Pseudomonas aeruginosa* exotoxin, *Cholera* toxin, *Shigella* toxin, *E. coli* heat labile toxin and Diptheria toxin, doxorubicin, daunomycin, methotrexate, taxol, ricin A, colchicine, cytochasins, monensin, ouabain, mitoxanthrone, vindesine, vinblastine, vincristine and enterotoxin.

Anti-metabolites include, but are not limited to, methotrexate, 5-fluorouracil, 6-mercaptopurine, cytosine arabinoside, hydroxyurea and 20-chlorodeoxyadenosine.

Signaling modulators include, but are not limited to, for example, inhibitors of macrophage inhibitory factor, toll-like receptor agonists and stat 3 inhibitors.

Anti-cancer antibiotics include, but are not limited to, anthracyclines such as doxorubicin hydrochloride (adriamycin), idarubicin hydrochloride, daunorubicin hydrochloride, aclarubicin Hydrochloride, epirubicin hydrochloride and purarubicin hydrochloride, enomycin, phenomycin, pleomycins such as pleomycin and peplomycin sulfate, mitomycins such as mitomycin C, actinomycins such as actinomycin D, zinostatinstimalamer and polypeptides such as neocarzinostatin.

Anti-cancer antibodies include, but are not limited to, Rituximab (RITUXAN), ADEPT, Trastuzumab (HERCEPTIN), Tositumomab (BEXXAR), Cetuximab (ERBITUX), Ibritumomab (90Y-Ibritumomab tiuexetan; ZEVALIN), Alemtuzumab (Campath-1H), Epratuzumab (Lymphocide), Gemtuzumab ozogamicin (MYLOTARG), Bevacimab (AVASTIN), and Edrecolomab (PANOREX).

Angiogenesis inhibitors include, but are not limited to, collagenase inhibitors such as metalloproteinases and tetracyclines such as minocycline, naturally occurring peptides such as endostatin and angiostatin, fungal and bacterial derivatives, such as fumagillin derivatives like TNP-470, aptamer antagonist of VEGF, batimastat, Captopril, cartilage derived inhibitor (CDI), genistein, interleukin 12, Lavendustin A, medroxyprogesterone acetate, recombinant human platelet factor 4(rPF4), taxol, D-gluco-D-galactan sulfate (Tecogalan(=SP-PG, DS-4152)), thalidomide, thrombospondin.

Radiation therapy includes, but is not limited to, photodynamic therapy, radionuclides, radioimmunotherapy and proton beam treatment.

Chemotherapeutic compounds include, but are not limited to platinum; platinum analogs (e.g., platinum coordination complexes) such as cisplatin, carboplatin, oxaliplatin, DWA2114R, NK121, IS 3 295, and 254-S; anthracenediones; vinblastine; alkylating agents such as thiotepa and cyclosphosphamide; alkyl sulfonates such as busulfan, improsulfan and piposulfan; aziridines such as benzodopa, carboquone, meturedopa and uredopa; ethylenimines and methylamelamines including altretamine, triethylenemelamine, trietylenephosphoramide, triethylenethiophosphaoramide and trimethylolomelamime nitrogen mustards such as chiorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elfornithine; elliptinium acetate; etoglucid; gallium nitrate; substituted ureas; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; anti-cancer polysaccharides; polysaccharide-K; razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; cytosine arabinoside; cyclophosphamide; thiotepa; taxoids, such as paclitaxel and doxetaxel; chlorambucil; gemcitabine; 6-thioguanine; mercaptopurine; methotrexate; etoposide (VP-16); ifosfamide; mitomycin C; mitoxantrone; vincristine; vinorelbine; navelbine; novantrone; teniposide; daunomycin; aminopterin; XELODA; ibandronate; CPT11; topoisomerase inhibitor RFS 2000; difluoromethylornithine (DMFO); retinoic acid; esperamicins; capecitabine; methylhydrazine derivatives; Erlotinib (TARCEVA); sunitinib malate (SUTENT); and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone and toremifene (FARESTON); adrenocortical suppressants; and antiandrogens such as flutamide, nilutamide, bicalutamide, leuprolide and goserelin; and pharmaceutically acceptable salts, acids or derivatives of any of the above. Such chemotherapeutic compounds that can be used herein include compounds whose toxicities preclude use of the compound in general systemic chemotherapeutic methods.

As used herein, an anti-cancer oligopeptide or an anti-tumor oligopeptide is short polypeptide that has the ability to slow or inhibit tumor growth and/or metastasis. Anti-cancer oligopeptide typically have high affinity for and specificity to tumors enabling them to target tumors. Such oligopeptides include receptor-interacting compounds, inhibitors of protein-protein interactions, enzyme inhibitors, and nucleic acid-interacting compounds. As used herein an antimitotic oligopeptide is an oligopeptide that inhibits cell division. An antimitotic oligopeptide is an exemplary anti-cancer oligopeptide. Exemplary antimitotic oligopeptides include, but are not limited to, tubulysin, phomopsin, hemiasterlin, taltobulin (HTI-286, 3), and cryptophycin.

As used herein, a prodrug is a compound that, upon in vivo administration, is metabolized or otherwise converted to the biologically, pharmaceutically or therapeutically active form of the compound. To produce a prodrug, the pharmaceutically active compound is modified such that the active compound is regenerated by metabolic processes. The prodrug can be designed to alter the metabolic stability or the transport characteristics of a drug, to mask side effects or toxicity, to improve the flavor of a drug or to alter other characteristics or properties of a drug. By virtue of knowledge of pharmacodynamic processes and drug metabolism in vivo, those of skill in this art, once a pharmaceutically active compound is known, can design prodrugs of the compound (see, e.g., Nogrady (1985) *Medicinal Chemistry A Biochemical Approach*, Oxford University Press, New York, pages 388-392). Prodrugs include, but are not limited to, 5-fluorocytosine, gancyclovir, 6-methylpurine deoxyriboside, cephalosporin-doxorubicin, 4-[(2-chloroethyl)(2-mesuloxyethyl)amino] benzoyl-L-glutamic acid, indole-3-acetic acid, 7-ethyl-10-[4-(1-piperidino)-1-piperidino]carbonyloxycampotothecin, bis-(2-chloroethyl)amino-4-hydroxyphenylaminomethanone 28, 1-chloromethyl-5-hydroxy-1,2-dihyro-3H-benz[e]indole, epirubicin-glucoronide, 5'-deoxy5-fluorouridine, cytosine arabinoside, and linamarin.

As used herein, a compound conjugated to a moiety refers to a complex that includes a compound bound to a moiety, where the binding between the compound and the moiety can arise from one or more covalent bonds or non-covalent interactions such as hydrogen bonds, or electrostatic interactions. A conjugate also can include a linker that connects the compound to the moiety. Exemplary compounds include, but are not limited to, nanoparticles and siderophores. Exemplary moieties, include, but are not limited to, detectable moieties and therapeutic agents.

As used herein, nanoparticle refers to a microscopic particle whose size is measured in nanometers. Often such particles in nanoscale are used in biomedical applications acting as drug carriers or imaging agents. Nanoparticles can be conjugated to other agents, including, but not limited to detectable/diagnostic agents or therapeutic agents.

As used herein, a detectable label or detectable moiety or diagnostic moiety (also imaging label, imaging agent, or imaging moiety) refers to an atom, molecule or composition, wherein the presence of the atom, molecule or composition can be directly or indirectly measured.

As used herein, a detectable moiety or an imaging moiety refer to moieties used to image a virus in any of the methods provided herein. Imaging (detectable) moieties include, for example, chemiluminescent moieties, bioluminescent moieties, fluorescent moieties, radionuclides and metals.

As used herein, a detection agent or an imaging agent refer to any molecule, compound, or polypeptide used to image a virus in any of the methods provided herein. Detection agents or imaging agents can contain, for example, a detectable moiety or can be a substrate, such as a luciferin, that produces a detectable signal following modification, such as by chemical modification by a luciferase.

As used herein, detect, detected and detecting refer generally to any manner of discovering or determining the presence of a signal, such as visual inspection, fluorescence spectroscopy, absorption, reflectance measurement, flow cytometry, magnetic resonance methods such as magnetic resonance imaging (MRI) and magnetic resonance spectroscopy (MRS), ultrasound, X-rays, gamma rays (after annihilation of a positron and an electron in PET scanning), tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography. Direct detection of a detectable label refers to, for example, measurement of a physical phenomenon, such as energy or particle emission or absorption of the moiety itself, such as by X-ray or MRI. Indirect detection refers to measurement of a physical phenomenon, such as energy or particle emission or absorption, of an atom, molecule or composition that binds directly or indirectly to the detectable moiety. In a non-limiting example of indirect detection, a detectable label can be biotin, which can be detected by binding to avidin. Non-labeled avidin can be administered systemically to block non-specific binding, followed by systemic administration of labeled avidin. Thus, included within the scope of a detectable label or detectable moiety is a bindable label or bindable moiety, which refers to an atom, molecule or composition, wherein the presence of the atom, molecule or composition can be detected as a result of the label or moiety binding to another atom, molecule or composition. Exemplary diagnostic agents include, for example, metals such as colloidal gold, iron, gadolinium, and gallium-67, fluorescent moieties and radionuclides. Exemplary fluorescent moieties and radionuclides are provided elsewhere herein.

As used herein, magnetic resonance imaging (MRI) refers to the use of a nuclear magnetic resonance spectrometer to produce electronic images of specific atoms and molecular structures in solids, especially human cells, tissues and organs. MRI is non-invasive diagnostic technique that uses nuclear magnetic resonance to produce cross-sectional images of organs and other internal body structures. The subject lies inside a large, hollow cylinder containing a strong electromagnet, which causes the nuclei of certain atoms in the body (such as, for example, $^1H$, $^{13}C$ and $^{19}F$) to align magnetically. The subject is then subjected to radio waves, which cause the aligned nuclei to flip; when the radio waves are withdrawn the nuclei return to their original positions, emitting radio waves that are then detected by a receiver and translated into a two-dimensional picture by computer. For some MRI procedures, contrast agents such as gadolinium are used to increase the accuracy of the images.

As used herein, an X-ray refers to a relatively high-energy photon, or a stream of such photons, having a wavelength in the approximate range from 0.01 to 10 nanometers. X-rays also refer to photographs taken with x-rays.

As used herein, "optical imaging" refers to imaging of a signal where at least some of the signal from the region of interest is in the form of an electromagnetic radiation in the visible light range. Non-limiting examples of optical imaging include detection of fluorescence and luminescence signals. Such signals can be captured by optical devices, such as a camera.

As used herein, "non-optical imaging" refers to imaging of a signal where at least some of the signal from the region of interest is in the form of electromagnetic radiation outside the visible range, and can include particles, and other propagations of energy. Non-limiting examples of non-optical imaging include detection of gamma rays (e.g., SPECT), X-rays, RF signals (e.g., MRI), particles such as electrons or positrons (e.g., PET), and other forms of energy propagations (e.g., ultrasound).

As used herein, nucleic acids include DNA, RNA and analogs thereof, including peptide nucleic acids (PNA) and mixtures thereof. Nucleic acids can be single or double-stranded. Nucleic acids can encode for example gene products, such as, for example, polypeptides, regulatory RNAs, siRNAs and functional RNAs.

As used herein, primer refers to an oligonucleotide containing two or more deoxyribonucleotides or ribonucleotides, typically more than three, from which synthesis of a primer extension product can be initiated. Typically a primer contains a free 3' hydroxy moiety. Experimental conditions conducive to synthesis of a gene product include the presence of nucleoside triphosphates and an agent for polymerization and extension, such as DNA polymerase, and a suitable buffer, temperature, and pH. When referring to probes or primers, which are optionally labeled, such as with a detectable label, such as a fluorescent or radiolabel, single-stranded molecules are provided. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 5, 6, 7, 8, 9, 10 or more, 20 or more, 30 or more, 50 or more, 100 or more nucleic acids long.

As used herein, a sequence complementary to at least a portion of an RNA, with reference to antisense oligonucleotides, means a sequence of nucleotides having sufficient complementarity to be able to hybridize with the RNA, generally under moderate or high stringency conditions, forming a stable duplex; in the case of double-stranded antisense nucleic acids, a single strand of the duplex DNA (i.e., dsRNA) can thus be tested, or triplex formation can be assayed. The ability to hybridize depends on the degree of complementarily and the length of the antisense nucleic acid. Generally, the longer the hybridizing nucleic acid, the more base mismatches with an encoding RNA it can contain and still form a stable duplex (or triplex, as the case can be). One skilled in the art can ascertain a tolerable degree of mismatch by use of standard procedures to determine the melting point of the hybridized complex.

As used herein, a heterologous nucleic acid (also referred to as exogenous nucleic acid or foreign nucleic acid) refers to a nucleic acid that is not normally produced in vivo by an organism or virus from which it is expressed or that is produced by an organism or a virus but is at a different locus, expressed differently, or that mediates or encodes mediators that alter expression of endogenous nucleic acid, such as DNA, by affecting transcription, translation, or other regulatable biochemical processes. Heterologous nucleic acid is often not endogenous to a cell or virus into which it is introduced, but has been obtained from another cell or virus or prepared synthetically. Heterologous nucleic acid can refer to a nucleic acid molecule from another cell in the same organism or another organism, including the same species or another species. Heterologous nucleic acid, however, can be endogenous, but is nucleic acid that is expressed from a different locus or altered in its expression or sequence (e.g., a plasmid). Thus, heterologous nucleic acid includes a nucleic acid molecule not present in the exact orientation or position as the counterpart nucleic acid molecule, such as DNA, is found in a genome. Generally, although not necessarily, such nucleic acid encodes RNA and proteins that are not normally produced by the cell or virus or in the same way in the cell in which it is expressed. Any nucleic acid, such as DNA, that one of skill in the art recognizes or considers as heterologous, exogenous or foreign to the cell in which the nucleic acid is expressed is herein encompassed by heterologous nucleic acid.

As used herein, a heterologous protein or heterologous polypeptide (also referred to as exogenous protein, exogenous polypeptide, foreign protein or foreign polypeptide) refers to a protein that is not normally produced in vivo by an organism.

As used herein, operative linkage of heterologous nucleic acids to regulatory and effector sequences of nucleotides, such as promoters, enhancers, transcriptional and translational stop sites, and other signal sequences refers to the relationship between such nucleic acid, such as DNA, and such sequences of nucleotides. For example, operative linkage of heterologous DNA to a promoter refers to the physical relationship between the DNA and the promoter such that the transcription of such DNA is initiated from the promoter by an RNA polymerase that specifically recognizes, binds to and transcribes the DNA. Thus, operatively linked or operationally associated refers to the functional relationship of a nucleic acid, such as DNA, with regulatory and effector sequences of nucleotides, such as promoters, enhancers, transcriptional and translational stop sites, and other signal sequences. For example, operative linkage of DNA to a promoter refers to the physical and functional relationship between the DNA and the promoter such that the transcription of such DNA is initiated from the promoter by an RNA polymerase that specifically recognizes, binds to and transcribes the DNA. In order to optimize expression and/or transcription, it can be necessary to remove, add or alter 5' untranslated portions of the clones to eliminate extra, potentially inappropriate, alternative translation initiation (i.e., start) codons or other sequences that can interfere with or reduce expression, either at the level of transcription or translation. In addition, consensus ribosome binding sites can be inserted immediately 5' of the start codon and can enhance expression (see, e.g., Kozak *J. Biol. Chem.* 266: 19867-19870 (1991); Shine and Delgarno *Nature* 254(5495): 34-38 (1975)). The desirability of (or need for) such modification can be empirically determined.

As used herein, a promoter, a promoter region or a promoter element or regulatory region or regulatory element refers to a segment of DNA or RNA that controls transcription of the DNA or RNA to which it is operatively linked. The promoter region includes specific sequences that are involved in RNA polymerase recognition, binding and transcription initiation. In addition, the promoter includes sequences that modulate recognition, binding and transcription initiation activity of RNA polymerase (i.e., binding of one or more transcription factors). These sequences can be cis acting or can be responsive to trans acting factors. Promoters, depending upon the nature of the regulation, can be constitutive or regulated. Regulated promoters can be inducible or environmentally responsive (e.g. respond to cues such as pH, anaerobic conditions, osmoticum, temperature, light, or cell density). Many such promoter sequences are known in the art. See, for example, U.S. Pat. Nos. 4,980,285; 5,631,150; 5,707, 928; 5,759,828; 5,888,783; 5,919,670, and, Sambrook, et al., *Molecular Cloning: A Laboratory Manual*, 2nd Ed., Cold Spring Harbor Press (1989).

As used herein, a native promoter is a promoter that is endogenous to the organism or virus and is unmodified with respect to its nucleotide sequence and its position in the viral genome as compared to a wild-type organism or virus.

As used herein, a heterologous promoter refers to a promoter that is not normally found in the wild-type organism or virus or that is at a different locus as compared to a wild-type organism or virus. A heterologous promoter is often not endogenous to a cell or virus into which it is introduced, but has been obtained from another cell or virus or prepared synthetically. A heterologous promoter can refer to a promoter from another cell in the same organism or another organism, including the same species or another species. A heterologous promoter, however, can be endogenous, but is a promoter that is altered in its sequence or occurs at a different locus (e.g., at a different location in the genome or on a plasmid). Thus, a heterologous promoter includes a promoter not present in the exact orientation or position as the counterpart promoter is found in a genome.

A synthetic promoter is a heterologous promoter that has a nucleotide sequence that is not found in nature. A synthetic promoter can be a nucleic acid molecule that has a synthetic sequence or a sequence derived from a native promoter or portion thereof A synthetic promoter can also be a hybrid promoter composed of different elements derived from different native promoters.

As used herein a "gene expression cassette" or "expression cassette" is a nucleic acid construct, containing nucleic acid elements that are capable of effecting expression of a gene in hosts that are compatible with such sequences. Expression cassettes include at least promoters and optionally, transcription termination signals. Typically, the expression cassette includes a nucleic acid to be transcribed operably linked to a promoter. Additional factors helpful in effecting expression can also be used as described herein. Expression cassettes can contain genes that encode, for example, a therapeutic gene product or a detectable protein or a selectable marker gene, As used herein, replacement of a promoter with a stronger promoter refers to removing a promoter from a genome and replacing it with a promoter that effects an increased the level of transcription initiation relative to the promoter that is replaced. Typically, a stronger promoter has an improved ability to bind polymerase complexes relative to the promoter that is replaced. As a result, an open reading frame that is operably linked to the stronger promoter has a higher level of gene expression. Similarly, replacement of a promoter with a weaker promoter refers to removing a promoter from a genome and replacing it with a promoter that decreases the level of transcription initiation relative to the promoter that is replaced. Typically, a weaker promoter has a lessened ability to bind polymerase complexes relative to the promoter that is replaced. As a result, an open reading frame that is operably linked to the weaker promoter has a lower level of gene expression.

As used herein, production by recombinant means by using recombinant DNA methods means the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Selection and use of such vectors are well known to those of skill in the art. An expression vector includes vectors capable of expressing DNA that is operatively linked with regulatory sequences, such as promoter regions, that are capable of effecting expression of such DNA fragments. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome. Vectors can be used in the generation of a recombinant genome by integration or homologous recombination, such as in the generation of a recombinant virus as described elsewhere herein.

As used herein, genetic therapy or gene therapy involves the transfer of heterologous nucleic acid, such as DNA or RNA, into certain cells, target cells, of a mammal, particularly a human, with a disorder or conditions for which such therapy is sought. As used herein, genetic therapy or gene therapy can involve the transfer of heterologous nucleic acid, such as DNA, into a virus, which can be transferred to a mammal, particularly a human, with a disorder or conditions for which such therapy is sought. The nucleic acid, such as DNA, is introduced into the selected target cells, such as directly or indirectly, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that is in some manner a therapeutic product, or which mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, a therapeutically effective product for gene therapy is a product that is encoded by heterologous nucleic acid, typically DNA, or an RNA product such as dsRNA, RNAi, including siRNA, that upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense nucleic acids.

As used herein, an agent or compound that modulates the activity of a protein or expression of a gene or nucleic acid either decreases or increases or otherwise alters the activity of the protein or, in some manner, up- or down-regulates or otherwise alters expression of the nucleic acid in a cell.

As used herein, recitation that amino acids of a polypeptide "correspond to" amino acids in a disclosed sequence, such as amino acids set forth in the Sequence listing, refers to amino acids identified upon alignment of the polypeptide with the disclosed sequence to maximize identity or homology (where conserved amino acids are aligned) using a standard alignment algorithm, such as the GAP algorithm. By aligning the sequences of polypeptides, one skilled in the art can identify corresponding residues, using conserved and identical amino acid residues as guides.

As used herein, "amino acids" are represented by their full name or by their known, three-letter or one-letter abbreviations (Table 1). The nucleotides which occur in the various nucleic acid fragments are designated with the standard single-letter designations used routinely in the art.

TABLE 1

Table of Correspondence

| SYMBOL | | |
|---|---|---|
| 1-Letter | 3-Letter | AMINO ACID |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |
| Q | Gln | glutamine |
| E | Glu | glutamic acid |
| Z | Glx | Glu and/or Gln |
| W | Trp | tryptophan |
| R | Arg | arginine |
| D | Asp | aspartic acid |
| N | Asn | asparagine |
| B | Asx | Asn and/or Asp |
| C | Cys | cysteine |
| X | Xaa | Unknown or other |

As used herein, the terms "homology" and "identity" are used interchangeably, but homology for proteins can include conservative amino acid changes. In general, to identify corresponding positions, the sequences of amino acids are aligned so that the highest order match is obtained (see, e.g., *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology vary). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215: 403 (1990); *Guide to Huge Computers*, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., $10/100$ amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

The term substantially identical or homologous or similar varies with the context as understood by those skilled in the relevant art and generally means at least 60% or 70%, preferably means at least 80%, more preferably at least 90%, and most preferably at least 95%, 96%, 97%, 98%, 99% or greater identity. As used herein, substantially identical to a product means sufficiently similar so that the property of interest is sufficiently unchanged so that the substantially identical product can be used in place of the product.

As used herein, substantially pure means sufficiently homogeneous to appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound can, however, be a mixture of stereoisomers or isomers. In such instances, further purification might increase the specific activity of the compound.

As used herein equivalent, when referring to two sequences of nucleic acids, means that the two sequences in question encode the same sequence of amino acids or equivalent proteins. When equivalent is used in referring to two proteins or peptides or other molecules, it means that the two proteins or peptides have substantially the same amino acid sequence with only amino acid substitutions (such as, but not limited to, conservative changes) or structure and the any changes do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, a receptor refers to a molecule that has an affinity for a ligand. Receptors can be naturally-occurring or synthetic molecules. Receptors also can be referred to in the art as anti-ligands. As used herein, the receptor and anti-ligand are interchangeable. Receptors can be used in their unaltered state or bound to other polypeptides, including as homodimers. Receptors can be attached to, covalently or noncovalently, or in physical contact with, a binding member, either directly or indirectly via a specific binding substance or linker. Examples of receptors, include, but are not limited to: antibodies, cell membrane receptors surface receptors and internalizing receptors, monoclonal antibodies and antisera reactive with specific antigenic determinants (such as on viruses, cells, or other materials), drugs, polynucleotides, nucleic acids, peptides, cofactors, lectins, sugars, polysaccharides, cells, cellular membranes, and organelles.

As used herein, bind, bound and binding refer to the binding between atoms or molecules with a $K_d$ in the range of $10^{-2}$ to $10^{-15}$ mole/L, generally, $10^{-6}$ to $10^{-15}$, $10^{-7}$ to $10^{-15}$ and typically $10^{-8}$ to $10^{-15}$ (and/or a $K_a$ of $10^5$-$10^{12}$, $10^7$-$10^{12}$, $10^8$-$10^{12}$ L/mole).

As used herein, luminescence refers to the detectable electromagnetic (EM) radiation, generally, ultraviolet (UV), infrared (IR) or visible EM radiation that is produced when the excited product of an exergonic chemical process reverts to its ground state with the emission of light. Chemiluminescence is luminescence that results from a chemical reaction. Bioluminescence is chemiluminescence that results from a chemical reaction using biological molecules (or synthetic versions or analogs thereof) as substrates and/or enzymes. Fluorescence is luminescence in which light of a visible color is emitted from a substance under stimulation or excitation by light or other forms radiation such as ultraviolet (UV), infrared (IR) or visible EM radiation.

As used herein, chemiluminescence refers to a chemical reaction in which energy is specifically channeled to a molecule causing it to become electronically excited and subsequently to release a photon thereby emitting visible light. Temperature does not contribute to this channeled energy. Thus, chemiluminescence involves the direct conversion of chemical energy to light energy.

As used herein, bioluminescence, which is a type of chemiluminescence, refers to the emission of light by biological molecules, particularly proteins. The essential condition for bioluminescence is molecular oxygen, either bound or free in the presence of an oxygenase, a luciferase, which acts on a substrate, a luciferin. Bioluminescence is generated by an enzyme or other protein (luciferase) that is an oxygenase that acts on a substrate luciferin (a bioluminescence substrate) in the presence of molecular oxygen and transforms the substrate to an excited state, which, upon return to a lower energy level releases the energy in the form of light.

As used herein, the substrates and enzymes for producing bioluminescence are generically referred to as luciferin and luciferase, respectively. When reference is made to a particular species thereof, for clarity, each generic term is used with the name of the organism from which it derives such as, for example, click beetle luciferase or firefly luciferase.

As used herein, luciferase refers to oxygenases that catalyze a light emitting reaction. For instance, bacterial luciferases catalyze the oxidation of flavin mononucleotide (FMN) and aliphatic aldehydes, which reaction produces light. Another class of luciferases, found among marine arthropods, catalyzes the oxidation of Cypridina (Vargula) luciferin and another class of luciferases catalyzes the oxidation of Coleoptera luciferin.

Thus, luciferase refers to an enzyme or photoprotein that catalyzes a bioluminescent reaction (a reaction that produces bioluminescence). The luciferases, such as firefly and Gaussia and *Renilla* luciferases are enzymes which act catalytically and are unchanged during the bioluminescence generating reaction. The luciferase photoproteins, such as the aequorin photoprotein to which luciferin is non-covalently bound, are changed, such as by release of the luciferin, during bioluminescence generating reaction. The luciferase is a protein, or a mixture of proteins (e.g., bacterial luciferase), that occurs naturally in an organism or a variant or mutant thereof, such as a variant produced by mutagenesis that has one or more properties, such as thermal stability, that differ from the naturally-occurring protein. Luciferases and modified mutant or variant forms thereof are well known. For purposes herein, reference to luciferase refers to either the photoproteins or luciferases.

Thus, reference, for example, to *Renilla* luciferase refers to an enzyme isolated from member of the genus *Renilla* or an equivalent molecule obtained from any other source, such as from another related copepod, or that has been prepared synthetically. It is intended to encompass *Renilla* luciferases with conservative amino acid substitutions that do not substantially alter activity. Conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224).

As used herein, bioluminescence substrate refers to the compound that is oxidized in the presence of a luciferase and any necessary activators and generates light. These substrates are referred to as luciferins herein, are substrates that undergo oxidation in a bioluminescence reaction. These bioluminescence substrates include any luciferin or analog thereof or any synthetic compound with which a luciferase interacts to generate light. Typical substrates include those that are oxidized in the presence of a luciferase or protein in a light-generating reaction. Bioluminescence substrates, thus, include those compounds that those of skill in the art recognize as luciferins. Luciferins, for example, include firefly luciferin, Cypridina (also known as Vargula) luciferin (coelenterazine), bacterial luciferin as well as synthetic analogs of these substrates or other compounds that are oxidized in the presence of a luciferase in a reaction the produces bioluminescence.

As used herein, capable of conversion into a bioluminescence substrate refers to being susceptible to chemical reaction, such as oxidation or reduction, which yields a bioluminescence substrate. For example, the luminescence producing reaction of bioluminescent bacteria involves the reduction of a flavin mononucleotide group (FMN) to reduced flavin mononucleotide ($FMNH_2$) by a flavin reductase enzyme. The reduced flavin mononucleotide (substrate) then reacts with oxygen (an activator) and bacterial luciferase to form an intermediate peroxy flavin that undergoes further reaction, in the presence of a long-chain aldehyde, to generate light. With respect to this reaction, the reduced flavin and the long chain aldehyde are bioluminescence substrates.

As used herein, a bioluminescence generating system refers to the set of reagents required to conduct a bioluminescent reaction. Thus, the specific luciferase, luciferin and other substrates, solvents and other reagents that can be required to complete a bioluminescent reaction form a bioluminescence system. Thus a bioluminescence generating system refers to any set of reagents that, under appropriate reaction conditions, yield bioluminescence. Appropriate reaction conditions refer to the conditions necessary for a bioluminescence reaction to occur, such as pH, salt concentrations and temperature. In general, bioluminescence systems include a bioluminescence substrate, luciferin, a luciferase, which includes enzymes luciferases and photoproteins and one or more activators. A specific bioluminescence system can be identified by reference to the specific organism from which the luciferase derives; for example, the *Renilla* bioluminescence system includes a *Renilla* luciferase, such as a luciferase isolated from *Renilla* or produced using recombinant methods or modifications of these luciferases. This system also includes the particular activators necessary to complete the bioluminescence reaction, such as oxygen and a substrate with which the luciferase reacts in the presence of the oxygen to produce light.

As used herein, a fluorescent protein (FP) refers to a protein that possesses the ability to fluoresce (i.e., to absorb energy at one wavelength and emit it at another wavelength). For example, a green fluorescent protein (GFP) refers to a polypeptide that has a peak in the emission spectrum at 510 nm or about 510 nm. A variety of FPs that emit at various wavelengths are known in the art. Exemplary FPs include, but are not limited to, a green fluorescent protein (GFP), yellow fluorescent protein (YFP), orange fluorescent protein (OFP), cyan fluorescent protein (CFP), blue fluorescent protein (BFP), red fluorescent protein (RFP), far-red fluorescent protein, or near-infrared fluorescent protein. Extending the spectrum of available colors of fluorescent proteins to blue, cyan, orange yellow and red variants, provides a method for multicolor tracking of fusion proteins.

As used herein, *Aequorea* GFP refers to GFPs from the genus *Aequorea* and to mutants or variants thereof. Such variants and GFPs from other species, such as *Anthozoa* reef coral, *Anemonia* sea anemone, *Renilla* sea pansy, *Galaxea* coral, *Acropora* brown coral, *Trachyphyllia* and *Pectiniidae* stony coral and other species are well known and are available and known to those of skill in the art. Exemplary GFP variants include, but are not limited to BFP, CFP, YFP and OFP. Examples of florescent proteins and their variants include GFP proteins, such as Emerald (Invitrogen, Carlsbad, Calif.), EGFP (Clontech, Palo Alto, Calif.), Azami-Green (MBL International, Woburn, Mass.), Kaede (MBL International, Woburn, Mass.), ZsGreen1 (Clontech, Palo Alto, Calif.) and CopGFP (Evrogen/Axxora, LLC, San Diego, Calif.); CFP proteins, such as Cerulean (Rizzo, *Nat Biotechnol*. 22(4): 445-9 (2004)), mCFP (Wang et al., *PNAS USA*. 101(48): 16745-9 (2004)), AmCyan1 (Clontech, Palo Alto, Calif.), MiCy (MBL International, Woburn, Mass.), and CyPet (Nguyen and Daugherty, *Nat Biotechnol*. 23(3):355-60 (2005)); BFP proteins such as EBFP (Clontech, Palo Alto, Calif.); YFP proteins such as EYFP (Clontech, Palo Alto, Calif.), YPet (Nguyen and Daugherty, *Nat Biotechnol*. 23(3): 355-60 (2005)), Venus (Nagai et al., *Nat. Biotechnol*. 20(1): 87-90 (2002)), ZsYellow (Clontech, Palo Alto, Calif.), and mCitrine (Wang et al., *PNAS USA*. 101(48):16745-9 (2004)); OFP proteins such as cOFP (Strategene, La Jolla, Calif.), mKO (MBL International, Woburn, Mass.), and mOrange; and others (Shaner N C, Steinbach P A, and Tsien R Y., *Nat Methods*. 2(12):905-9 (2005)).

As used herein, red fluorescent protein, or RFP, refers to the *Discosoma* RFP (DsRed) that has been isolated from the corallimorph *Discosoma* (Matz et al., *Nature Biotechnology* 17: 969-973 (1999)), and red or far-red fluorescent proteins from any other species, such as *Heteractis* reef coral and *Actinia* or *Entacmaea* sea anemone, as well as variants thereof RFPs include, for example, *Discosoma* variants, such as mRFP1, mCherry, tdTomato, mStrawberry, mTangerine (Wang et al., *PNAS USA*. 101(48):16745-9 (2004)), DsRed2 (Clontech, Palo Alto, Calif.), and DsRed-T1 (Bevis and Glick, *Nat. Biotechnol.*, 20: 83-87 (2002)), *Anthomedusa* J-Red (Evrogen) and *Anemonia* AsRed2 (Clontech, Palo Alto, Calif.). Far-red fluorescent proteins include, for example, *Actinia* AQ143 (Shkrob et al., *Biochem J*. 392(Pt 3):649-54 (2005)), *Entacmaea* eqFP611 (Wiedenmann et al. *Proc Natl Acad Sci USA*. 99(18):11646-51 (2002)), *Discosoma* variants such as mPlum and mRasberry (Wang et al., *PNAS USA*. 101(48):16745-9 (2004)), and *Heteractis* HcRed1 and t-HcRed (Clontech, Palo Alto, Calif.).

As used herein the term assessing or determining is intended to include quantitative and qualitative determination in the sense of obtaining an absolute value for the activity of a product, and also of obtaining an index, ratio, percentage, visual or other value indicative of the level of the activity. Assessment can be direct or indirect.

As used herein, activity refers to the in vivo activities of a compound or viruses on physiological responses that result following in vivo administration thereof (or of a composition or other mixture). Activity, thus, encompasses resulting therapeutic effects and pharmaceutical activity of such compounds, compositions and mixtures. Activities can be observed in in vitro and/or in vivo systems designed to test or use such activities.

As used herein, a vaccine refers to a composition which, upon administration to a subject, elicits an immune response in a subject to which it is administered and which protects the immunized subject against subsequent challenge by the immunizing agent or an immunologically cross-reactive agent. A vaccine can be used to enhance the immune response against a pathogen, such as a virus, that expresses the immunological agent and/or has already infected the subject. Protection can be complete or partial (i.e., a reduction in symptoms or infection as compared with an unvaccinated subject). Typically a vaccine is administered to a subject that is a mammal. An immunologically cross-reactive agent can be, for example, the whole protein (e.g., tumor antigen) from which a subunit peptide used as the immunogen is derived. Alternatively, an immunologically cross-reactive agent can be a different protein which is recognized in whole or in part by the antibodies elicited by the immunizing agent. Exemplary vaccines can be modified vaccinia viruses that express an immunologically cross-reactive agent.

As used herein, a "pharmaceutically acceptable carrier" refers to any carrier, diluent, excipient, wetting agent, buffering agent, suspending agent, lubricating agent, adjuvant, solid binder, vehicle, delivery system, emulsifier, disintegrant, absorbent, preservative, surfactant, colorant, flavorant, or sweetener, preferably non-toxic, that are suitable for use in a pharmaceutical composition.

As used herein, complex refers generally to an association between two or more species regardless of the nature of the interaction between the species (i.e., ionic, covalent, or electrostatic).

As used herein, "a combination" refers to any association between two or among more items or elements. Exemplary combinations include, but are not limited to, two or more pharmaceutical compositions, a composition containing two or more active ingredients, such as two viruses, or a virus and a chemotherapeutic compound, two or more viruses, a virus and a therapeutic agent, a virus and an imaging agent, a virus and a plurality therapeutic and/or imaging agents, or any association thereof. Such combinations can be packaged as kits.

As used herein, a composition refers to any mixture. It can be a solution, a suspension, an emulsion, liquid, powder, a paste, aqueous, non-aqueous or any combination of such ingredients.

As used herein, fluid refers to any composition that can flow. Fluids thus encompass compositions that are in the form of semi-solids, pastes, solutions, aqueous mixtures, gels, lotions, creams and other such compositions.

As used herein, a kit is a packaged combination, optionally, including instructions for use of the combination and/or other reactions and components for such use.

For clarity of disclosure, and not by way of limitation, the detailed description is divided into the subsections that follow.

B. Viruses for Treatment and Diagnosis

Provided herein are viruses for therapeutic and diagnostic use. Also provided elsewhere herein are methods for making and using such viruses for therapeutic and diagnostic uses. The viruses provided herein encode gene products that can enhance the uptake or retention of compounds useful for diagnostic and/or therapeutic purposes. Exemplary of such viruses are viruses that encode a transporter protein. The viruses provided herein that encode a transporter protein can localize to and infect target cells, such as tumor cells, resulting expression of the transporter protein by the infected cells. Transporter proteins expressed by an infected cell can result in increased uptake diagnostic and therapeutic moieties across the cell membrane. Diagnostic moieties include those that can emit a signal that is detectable by optical or non-optical imaging methods. Detection of the signal by imaging modalities such as, for example, by positron emission tomography (PET) and, thereby allows visualization of the infected tissues, such a tumor or an inflammation.

Exemplary diagnostic moieties are provided elsewhere herein and include radiolabeled compounds that can be imaged in a subject. The uptake of such compounds by the expressed transporter protein allows amplification of signal emitted by the compounds due to the increased accumulation of the labeled compound in the infected cells. Hence, the transporter-based imaging methods using the viruses provided herein can result in greater signal strength at the target tissue as compared to receptor-based imaging methods because a higher number of diagnostic moieties can be taken up by the infected cells as compared to the limited binding of one moiety to one receptor. Thus such methods can provide high signal to noise ratios in vivo for infected versus non-infected tissues.

Exemplary transporter proteins that can be encoded by the viruses provided herein are listed elsewhere herein and include, for example, the human norepinephrine transporter (hNET) and the human sodium iodide symporter (hNIS). Exemplary viruses provided herein that encode the human norepinephrine transporter (hNET) include, but are not limited to, GLV-1h99, GLV-1h100, GLV-1h101, GLV-1h139, GLV-1h146 and GLV-1h150. Exemplary viruses provided herein that encode the human sodium iodide symporter (hNIS) include, but are not limited to, GLV-1h151, GLV-1h152 and GLV-1h153.

The viruses provided herein that encode a transporter protein are typically attenuated. Attenuated viruses have a decreased capacity to cause disease in a host. The decreased capacity can result from any of a variety of different modifications to the ability of a virus to be pathogenic. For example, a virus can have reduced toxicity, reduced ability to accumulate in non-tumorous organs or tissue, reduced ability to cause cell lysis or cell death, or reduced ability to replicate compared to the non-attenuated form thereof. The attenuated viruses provided herein, however, retain at least some capacity to replicate and to cause immunoprivileged cells and tissues, such as tumor cells to leak or lyse, undergo cell death, or otherwise cause or enhance an immune response to immunoprivileged cells and tissues, such as tumor cells. Such characteristics of the viruses provided are described in detail elsewhere herein.

The viruses provided herein that encode a transporter protein can accumulate in and infect immunoprivileged cells or immunoprivileged tissues, including tumors and/or metastases, and also including inflamed or wounded tissues and cells. While the viruses provided herein can typically be cleared from the subject to whom the viruses are administered by activity of the subject's immune system, viruses can nevertheless accumulate, survive and proliferate in immunoprivileged cells and tissues such as tumors because such immunoprivileged areas are sequestered from the host's immune system. Accordingly, the methods provided herein, as applied to tumors and/or metastases, and diagnostic and therapeutic methods relating thereto, can readily be applied to other immunoprivileged cells and tissues, including inflamed and wounded cells and tissues.

Among the viruses provided herein that encode a transporter protein are cytoplasmic viruses, which do not require entry of viral nucleic acid molecules in to the nucleus of the host cell during the viral life cycle. Exemplary cytoplasmic viruses provided herein are viruses of the poxvirus family, including orthopoxviruses. Exemplary of poxviruses provided herein are vaccinia viruses. Vaccinia virus possesses a variety of features for use in cancer gene therapy and vaccination, including broad host and cell type range, a large carrying capacity for foreign genes and high sequence homology among different strains for designing and generating modified viruses in other strains. Techniques for production of modified vaccinia strains by genetic engineering are well established (Moss (1993) Curr. Opin. Genet. Dev. 3: 86-90; Broder and Earl (1999) Mol. Biotechnol. 13: 223-245; Timiryasova et al. (2001) Biotechniques 31: 534-540). A variety of vaccinia virus strains are available, including Western Reserve (WR), Copenhagen, Tashkent, Tian Tan, Lister, Wyeth, IHD-J, and IHD-W, Brighton, Ankara, MVA, Dairen I, LIPV, LC16M8, LC16MO, LIVP, WR 65-16, Connaught, New York City Board of Health. Exemplary of vaccinia viruses provided herein are Lister strain or LIVP vaccinia viruses.

The modifications of the Lister strain provided herein also can be adapted to other vaccinia viruses (e.g., Western Reserve (WR), Copenhagen, Tashkent, Tian Tan, Lister, Wyeth, IHD-J, and IHD-W, Brighton, Ankara, MVA, Dairen I, LIPV, LC16M8, LC16MO, LIVP, WR 65-16, Connaught, New York City Board of Health). The modifications of the Lister strain provided herein also can be adapted to other viruses, including, but not limited to, viruses of the poxvirus family, adenoviruses, herpes viruses and retroviruses.

Typically, DNA encoding the transporter protein is inserted into a nonessential gene of the virus genome that does not significantly affecting viral replication and infection in the target tissue. For example, in a vaccinia virus, non essential gene loci include, but are not limited to, TK, HA, F14.5L, E2L/E3L, K1L/K2L, superoxide dismutase locus, 7.5K, C7-K1L, J2R, B13R+B14R, A56R, A26L or I4L gene loci. The heterologous nucleic acid encoding the transporter is typically operably linked to a promoter for expression of the transporter protein in the infected cells. Suitable promoter include viral promoters, such as a vaccinia virus natural and synthetic promoters. Exemplary vaccinia viral promoters include, but are not limited to, P11k, P7.5k early/late, P7.5k early, P28 late, synthetic early $P_{SE}$, synthetic early/late $P_{SEL}$ and synthetic late $P_{SL}$ promoters.

Exemplary vaccinia viruses provided herein that encode a transporter protein were derived from vaccinia virus strain GLV-1h68 (also named RVGL21, SEQ ID NO: 1). GLV-1h68, which has been described in U.S. Pat. Pub. No. 2005-0031643, contains DNA insertions gene loci of the vaccinia virus LIVP strain (a vaccinia virus strain, originally derived by adapting the Lister strain (ATCC Catalog No. VR-1549) to calf skin (Institute of Viral Preparations, Moscow, Russia, Al'tshtein et al., (1983) Dokl. Akad. Nauk USSR 285:696-699)). GLV-1h68 contains expression cassettes encoding detectable marker proteins in the F14.5L (also designated in LIVP as F3) gene locus, thymidine kinase (TK) gene locus, and hemagglutinin (HA) gene locus. An expression cassette containing a Ruc-GFP cDNA molecule (a fusion of DNA encoding Renilla luciferase and DNA encoding GFP) under the control of a vaccinia synthetic early/late promoter $P_{SEL}$ (($P_{SEL}$)Ruc-GFP) was inserted into the F14.5L gene locus; an expression cassette containing a DNA molecule encoding beta-galactosidase under the control of the vaccinia early/late promoter $P_{7.5k}$ (($P_{7.5k}$)LacZ) and DNA encoding a rat transferrin receptor positioned in the reverse orientation for transcription relative to the vaccinia synthetic early/late promoter $P_{SEL}$ (($P_{SEL}$)rTrfR) was inserted into the TK gene locus (the resulting virus does not express transferrin receptor protein since the DNA molecule encoding the protein is positioned in the reverse orientation for transcription relative to the promoter in the cassette); and an expression cassette containing a DNA molecule encoding β-glucuronidase under the control of the vaccinia late promoter $P_{11k}$ (($P_{11k}$)gusA) was inserted into the HA gene locus. The GLV-1h68 virus exhibited a strong preference for accumulation in tumor tissues as compared to non-tumorous tissues following systemic administration of the virus to tumor bearing subjects. This preference was significantly higher than the tumor selective accumulation of other vaccinia viral strains, such as WR (see, e.g. U.S. Pat. Pub. No. 2005-0031643 and Zhang et al. (2007) *Cancer Res.* 67(20):10038-46). The viruses provided herein that encode a transporter protein were generated by replacement of one or more expression cassettes of the GLV-1h68 strain with heterologous DNA encoding a transporter protein.

In some examples, nucleic acid encoding the transporter protein can be introduced into a viral genome that contains one or more additional heterologous genes or is modified by removal or replacement of one or more viral genes to attenuate the virus. The heterologous genes can encode additional diagnostic or therapeutic proteins as described elsewhere herein. Non-limiting examples viruses that can be modified by insertion of a nucleic acid encoding a transporter protein include attenuated Lister strain LIVP viruses including, but not limited to, LIVP viruses described in U.S. Patent Publication Nos. 2005/0031643, 2004/0234455 and 2004/0213741 and U.S. patent application Ser. No. 11/975,088. Exemplary viruses contained therein that can be modified as described here include viruses which have one or more expression cassettes removed from GLV-1h68 and replaced with a heterologous non-coding DNA molecule (e.g., GLV-1h70, GLV-1h71, GLV-1h72, GLV-1h73, GLV-1h74, GLV-1h85, and GLV-1h86). GLV-1h70 contains ($P_{SEL}$)Ruc-GFP inserted into the F14.5L gene locus, ($P_{SEL}$)rTrfR and ($P_{7.5k}$)LacZ inserted into the TK gene locus, and a non-coding DNA molecule inserted into the HA gene locus in place of ($P_{11k}$)gusA. GLV-1h71 contains a non-coding DNA molecule inserted into the F14.5L gene locus in place of ($P_{SEL}$)Ruc-GFP, ($P_{SEL}$)rTrfR and ($P_{7.5k}$)LacZ inserted into the TK gene locus, and ($P_{11k}$)gusA inserted into the HA gene locus. GLV-1h72 contains ($P_{SEL}$)Ruc-GFP inserted into the F14.5L gene locus, a non-coding DNA molecule inserted into the TK gene locus in place of ($P_{SEL}$)rTrfR and ($P_{7.5k}$)LacZ, and $P_{11k}$gusA inserted into the HA gene locus. GLV-1h73 contains a non-coding DNA molecule inserted into the F14.5L gene locus in place of ($P_{SEL}$)Ruc-GFP, ($P_{SEL}$)rTrfR and ($P_{7.5k}$)LacZ inserted into the TK gene locus, and a non-coding DNA molecule inserted into the HA gene locus in place of ($P_{11k}$)gusA. GLV-1h74 contains a non-coding DNA molecule inserted into the F14.5L gene locus in place of ($P_{SEL}$)Ruc-GFP, a non-coding DNA molecule inserted into the TK gene locus in place of ($P_{SEL}$)rTrfR and ($P_{7.5k}$)LacZ, and a non-coding DNA molecule inserted into the HA gene locus in place of ($P_{11k}$)gusA. GLV-1h85 contains a non-coding DNA molecule inserted into the F14.5L gene locus in place of ($P_{SEL}$)Ruc-GFP, a non-coding DNA molecule inserted into the TK gene locus in place of ($P_{SEL}$)rTrfR and ($P_{7.5k}$)LacZ, and ($P_{11k}$)gusA inserted into the HA gene locus. GLV-1h86 contains ($P_{SEL}$)Ruc-GFP inserted into the F14.5L gene locus, a non-coding DNA molecule inserted into the TK gene locus in place of ($P_{SEL}$)rTrfR and ($P_{7.5k}$)LacZ, and a non-coding DNA molecule inserted into the HA gene locus in place of ($P_{11k}$)gusA. Other exemplary viruses include, but are not limited to, LIVP viruses that express one or more therapeutic gene products, such as angiogenesis inhibitors (e.g., GLV-1h81, which contains DNA encoding the plasminogen K5 domain (SEQ ID NO: 109) under the control of the vaccinia synthetic early-late promoter in place of the gusA expression cassette in GLV-1h68; GLV-1h104, GLV-1h105 and GLV-1h106, which contain DNA encoding a truncated human tissue factor fused to the $α_vβ_3$-integrin RGD binding motif (tTF-RGD) (SEQ ID NO: 105) under the control of a vaccinia synthetic early promoter, vaccinia synthetic early/late promoter or vaccinia synthetic late promoter, respectively, in place of the LacZ/rTFr expression cassette at the TK locus of GLV-1h68; GLV-1h107, GLV-1h108 and GLV-1h109, which contain DNA encoding an anti-VEGF single chain antibody G6 (SEQ ID NO: 106) under the control of a vaccinia synthetic early promoter, vaccinia synthetic early/late promoter or vaccinia synthetic late promoter, respectively, in place of the LacZ/rTFr expression cassette at the TK locus of GLV-1h68) and proteins for tumor growth suppression (e.g., GLV-1h90, GLV-1h91 and GLV-1h92, which express a fusion protein containing an IL-6 fused to an IL-6 receptor (sIL-6R/IL-6) (SEQ ID NO: 108) under the control of a vaccinia synthetic early promoter, vaccinia synthetic early/late promoter or vaccinia synthetic late promoter, respectively, in place of the gusA expression cassette in GLV-1h68; and GLV-1h96, GLV-1h97 and GLV-1h98, which express IL-24 (melanoma differentiation gene, mda-7; SEQ ID NO: 107) under the control of a vaccinia synthetic early promoter, vaccinia synthetic early/late promoter or vaccinia synthetic late promoter, respectively, in place of the Ruc-GFP fusion gene expression cassette at the F14.5L locus of GLV-1h68). Additional therapeutic gene products that can be engineered in the viruses provided herein also are described elsewhere herein.

C. Transporter Proteins

Membrane transport proteins, also known as transporters, are proteins involved in the movement of ions, small molecules, or macromolecules, such as other proteins, across a membrane. Transport proteins are integral membrane proteins that span the membrane across which they transport substances. These proteins can assist in the movement of substances by facilitated diffusion or active transport. Transporters can be located on the outer cell membrane, mitochondria or other intracellular organelles. When expressed in viruses using the methods described herein, these transporters can function to transport and accumulate detectable and/or therapeutic substrates in cells, such as tumor cells. For example, transporters can provide signal amplification through transport-mediated concentrative intracellular accumulation of radiolabeled substrates for use in imaging, and can provide a means to deliver therapeutic substances to virally-targeted tumors.

Transporters can be classified and identified using various systems and databases well known in the art. Such systems can be used to help identify transporters that can be expressed in the viruses using the methods described herein, and to identify the substrates for each transporter. For example, the Transporter Classification database (TCDB; www.tcdb.org/) is an IUBMB (International Union of Biochemistry and Molecular Biology)-approved classification system for membrane transport proteins, including ion channels (Saier et al., (2006) Nucl. Acids. Res. 34: D181-D186). This was designed to be analogous to the EC number system for classifying enzymes, but it also uses phylogenetic information. The TC system classifies approximately 3000 proteins into over 550 transporter families. Another system is the Solute Carrier (SLC) gene nomenclature system, which is the basis for the Human Genome Organization (HUGO) names of the genes that encode this group of transporters, and includes over 300 members organized into 47 families. Members within an individual SLC family have greater than 20% sequence homology to each other. The criteria for inclusion of a family into the SLC group is functional (i.e., an integral membrane protein which transports a solute) rather than evolutionary. The SLC group include transporters that are facilitative transporters (allow solutes to flow downhill with their electrochemical gradients) and secondary active transporters (allow solutes to flow uphill against their electrochemical gradient by coupling to transport of a second solute that flows downhill with its gradient such that the overall free energy change is still favorable). The SLC group does not include ATP-driven transporters, ion channels or aquaporins. Most members of the SLC group are located in the outer cell membrane, although some members are located in mitochondria (most notably SLC family 25) or other intracellular organelles. Table 2 provides the SLC families (e.g. SLC1), the subfamiles (e.g. SLC1A) and the member of the family (e.g. SLC1A1, corresponding to "Solute carrier family 1, member 1").

TABLE 2

Solute Carrier (SLC) Transporter families

| Family | Members |
|---|---|
| SLC1: The high affinity glutamate and neutral amino acid transporter family | SLC1A1, SLC1A2, SLC1A3, SLC1A4, SLC1A5, SLC1A6, SLC1A7 |
| SLC2: The facilitative GLUT transporter family | SLC2A1, SLC2A2, SLC2A3, SLC2A4, SLC2A5, SLC2A6, SLC2A7, SLC2A8, SLC2A9, SLC2A10, SLC2A11, SLC2A12, SLC2A13, SLC2A14 |
| SLC3: The heavy subunits of the heteromeric amino acid transporters | SLC3A1, SLC3A2 |
| SLC4: The bicarbonate transporter family | SLC4A1, SLC4A2, SLC4A3, SLC4A4, SLC4A5, SLC4A6, SLC4A7, SLC4A8, SLC4A9, SLC4A10, SLC4A11 |
| SLC5: The sodium glucose cotransporter family | SLC5A1, SLC5A2, SLC5A3, SLC5A4, SLC5A5, SLC5A6, SLC5A7, SLC5A8, SLC5A9, SLC5A10, SLC5A11, SLC5A12 |
| SLC6: The sodium- and chloride-dependent neurotransmitter transporter family | SLC6A1, SLC6A2, SLC6A3, SLC6A4, SLC6A5, SLC6A6, SLC6A7, SLC6A8, SLC6A9, SLC6A10, SLC6A11, SLC6A12, SLC6A13, SLC6A14, SLC6A15, SLC6A16, SLC6A17, SLC6A18, SLC6A19, SLC6A20 |
| SLC7: The cationic amino acid transporter/glycoprotein-associated family | SLC7A1, SLC7A2, SLC7A3, SLC7A4, SLC7A5, SLC7A6, SLC7A7, SLC7A8, SLC7A9, SLC7A10, SLC7A11, SLC7A13, SLC7A14 |
| SLC8: The Na+/Ca2+ exchanger family | SLC8A1, SLC8A2, SLC8A3 |
| SLC9: The Na+/H+ exchanger family | SLC9A1, SLC9A2, SLC9A3, SLC9A4, SLC9A5, SLC9A6, SLC9A7, SLC9A8, SLC9A9, SLC9A10, SLC9A11 |
| SLC10: The sodium bile salt cotransport family | SLC10A1, SLC10A2, SLC10A3, SLC10A4, SLC10A5, SLC10A6, SLC10A7 |
| SLC11: The proton coupled metal ion transporter family | SLC11A1, SLC11A2 |
| SLC12: The electroneutral cation-Cl cotransporter family | SLC12A1, SLC12A1, SLC12A2, SLC12A3, SLC12A4, SLC12A5, SLC12A6, SLC12A7, SLC12A8, SLC12A9 |
| SLC13: The human Na+-sulfate/carboxylate cotransporter family | SLC13A1, SLC13A2, SLC13A3, SLC13A4, SLC13A5 |
| SLC14: The urea transporter family | SLC14A1, SLC14A2 |
| SLC15: The proton oligopeptide cotransporter family | SLC15A1, SLC15A2, SLC15A3, SLC15A4 |
| SLC16: The monocarboxylate transporter family | SLC16A1, SLC16A2, SLC16A3, SLC16A4, SLC16A5, SLC16A6, SLC16A7, SLC16A8, SLC16A9, SLC16A10, SLC16A11, SLC16A12, SLC16A13, SLC16A14 |
| SLC17: The vesicular glutamate transporter family | SLC17A1, SLC17A2, SLC17A3, SLC17A4, SLC17A5, SLC17A6, SLC17A7, SLC17A8 |
| SLC18: The vesicular amine transporter family | SLC18A1, SLC18A2, SLC18A3 |
| SLC19: The folate/thiamine transporter family | SLC19A1, SLC19A2, SLC19A3 |
| SLC20: The type III Na+-phosphate cotransporter family | SLC20A1, SLC20A2 |
| SLC21/SLCO: The organic anion transporting family | subfamily 1; SLCO1A2, SLCO1B1, SLCO1B3, SLCO1B4, SLCO1C1<br>subfamily 2; SLCO2A1, SLCO2B1<br>subfamily 3; SLCO3A1<br>subfamily 4; SLCO4A1, SLCO4C1<br>subfamily 5; SLCO5A1 |

TABLE 2-continued

Solute Carrier (SLC) Transporter families

| Family | Members |
|---|---|
| SLC22: The organic cation/anion/zwitterion transporter family | SLC22A1, SLC22A2, SLC22A3, SLC22A4, SLC22A5, SLC22A6, SLC22A7, SLC22A8, SLC22A9, SLC22A10, SLC22A11, SLC22A12, SLC22A13, SLC22A14, SLC22A15, SLC22A16, SLC22A17, SLC22A18, SLC22A19, SLC22A20 |
| SLC23: The Na+-dependent ascorbic acid transporter family | SLC23A1, SLC23A2, SLC23A3, SLC23A4 |
| SLC24: The Na+/(Ca2+-K+) exchanger family | SLC24A1, SLC24A2, SLC24A3, SLC24A4, SLC24A5, SLC24A6 |
| SLC25: The mitochondrial carrier family | SLC25A1, SLC25A2, SLC25A3, SLC25A4, SLC25A5, SLC25A6, SLC25A7, SLC25A8, SLC25A9, SLC25A10, SLC25A11, SLC25A12, SLC25A13, SLC25A14, SLC25A15, SLC25A16, SLC25A17, SLC25A18, SLC25A19, SLC25A20, SLC25A21, SLC25A22, SLC25A23, SLC25A24, SLC25A25, SLC25A26, SLC25A27, SLC25A28, SLC25A29, SLC25A30, SLC25A31, SLC25A32, SLC25A33, SLC25A34, SLC25A35, SLC25A36, SLC25A37, SLC25A38, SLC25A39, SLC25A40, SLC25A41, SLC25A42, SLC25A43, SLC25A44, SLC25A45, SLC25A46 |
| SLC26: The multifunctional anion exchanger family | SLC26A1, SLC26A2, SLC26A3, SLC26A4, SLC26A5, SLC26A6, SLC26A7, SLC26A8, SLC26A9, SLC26A10, SLC26A11 |
| SLC27: The fatty acid transport protein family | SLC27A1, SLC27A2, SLC27A3, SLC27A4, SLC27A5, SLC27A6 |
| SLC28: The Na+-coupled nucleoside transport family | SLC28A1, SLC28A2, SLC28A3 |
| SLC29: The facilitative nucleoside transporter family | SLC29A1, SLC29A2, SLC29A3, SLC29A4 |
| SLC30: The zinc efflux family | SLC30A1, SLC30A2, SLC30A3, SLC30A4, SLC30A5, SLC30A6, SLC30A7, SLC30A8, SLC30A9, SLC30A10 |
| SLC31: The copper transporter family | SLC31A1 |
| SLC32: The vesicular inhibitory amino acid transporter family | SLC32A1 |
| SLC33: The Acety-CoA transporter family | SLC33A1 |
| SLC34: The type II Na+-phosphate cotransporter family | SLC34A1, SLC34A2, SLC34A3 |
| SLC35: The nucleoside-sugar transporter family | subfamily A; SLC35A1, SLC35A2, SLC35A3, SLC35A4, SLC35A5<br>subfamily B; SLC35B1, SLC35B2, SLC35B3, SLC35B4<br>subfamily C; SLC35C1, SLC35C2<br>subfamily D; SLC35D1, SLC35D2, SLC35D3<br>subfamily E; SLC35E1, SLC35E2, SLC35E3, SLC35E4 |
| SLC36: The proton-coupled amino acid transporter family | SLC36A1, SLC36A2, SLC36A3, SLC36A4 |
| SLC37: The sugar-phosphate/phosphate exchanger family | SLC37A1, SLC37A2, SLC37A3, SLC37A4 |
| SLC38: The System A & N, sodium-coupled neutral amino acid transporter family | SLC38A1, SLC38A2, SLC38A3, SLC38A4, SLC38A5, SLC38A6 |
| SLC39: The metal ion transporter family | SLC39A1, SLC39A2, SLC39A3, SLC39A4, SLC39A5, SLC39A6, SLC39A7, SLC39A8, SLC39A9, SLC39A10, SLC39A11, SLC39A12, SLC39A13, SLC39A14 |
| SLC40: The basolateral iron transporter family | SLC40A1 |
| SLC41: The MgtE-like magnesium transporter family | SLC41A1, SLC41A2, SLC41A3 |
| SLC42: The Rh ammonium transporter family (pending) | RHAG, RhBG, RhCG |
| SLC43: Na+-independent, system-L like amino acid transporter family | SLC43A1, SLC43A2, SLC43A3 |
| SLC44: Choline-like transporter family | SLC44A1, SLC44A2, SLC44A3, SLC44A4, SLC44A5 |

TABLE 2-continued

Solute Carrier (SLC) Transporter families

| Family | Members |
| --- | --- |
| SLC45: Putative sugar transporter family | SLC45A1, SLC45A2, SLC54A3, SLC45A4 |
| SLC46: Heme transporter family | SLC46A1, SLC46A2 |
| SLC47: Multidrug and toxin extrusion | SLC47A1, SLC47A2 |

1. The Sodium- and Chloride-Dependent Neurotransmitter Transporter Family

Exemplary of transporters for use in the viruses and methods described herein are members of the sodium- and chloride-dependent neurotransmitter transporter family (Solute carrier family 6; SLC6), also known as the sodium/neurotransmitter symporter family (SNF) or the neurotransmitter/sodium symporter family (NSS) of neurotransmitter transporters, which corresponds to TC 2.A.22 using the TCDB system). Transporters in this family derive energy from the co-transport of $Na^+$ and $Cl^-$ in order to transport neurotransmitter molecules into the cell against their concentration gradient. The family has a common structure of 12 conserved transmembrane helices and includes transporters for gamma-aminobutyric acid (GABA), noradrenaline/adrenaline, dopamine, serotonin, proline, glycine, choline, betaine and taurine. Sequence analysis of the $Na^+/Cl^-$ neurotransmitter superfamily reveals that it can be divided into four subfamilies, these being transporters for monoamines, the amino acids proline and glycine, GABA, and a group of orphan transporters (Nelson et al. (1998) Methods Enzymol. 296:425-436). Table 3 sets forth the gene name of exemplary members of this family, the corresponding protein name and the sequence identifier of the corresponding human protein.

TABLE 3

SLC6 family members

| SLC6 gene | Protein name | SEQ ID NO: |
| --- | --- | --- |
| SLC6A1 | sodium- and chloride-dependent GABA transporter 1 | SEQ ID NO: 36 |
| SLC6A2 | norepinephrine transporter (sodium-dependent noradrenaline transporter) | SEQ ID NO: 26 |
| SLC6A3 | sodium-dependent dopamine transporter | SEQ ID NO: 35 |
| SLC6A4 | sodium-dependent serotonin transporter | SEQ ID NO: 34 |
| SLC6A5 | sodium- and chloride-dependent glycine transporter 1 | SEQ ID NO: 40 |
| SLC6A6 | sodium-and chloride-dependent taurine transporter | SEQ ID NO: 42 |
| SLC6A7 | sodium-dependent proline transporter | SEQ ID NO: 41 |
| SLC6A8 | sodium- and chloride-dependent creatine transporter | SEQ ID NO: 44 |
| SLC6A9 | sodium- and chloride-dependent glycine transporter 1, isoform 1 | SEQ ID NO: 40 |
|  | sodium- and chloride-dependent glycine transporter 1, isoform 2 | SEQ ID NO: 95 |
|  | sodium- and chloride-dependent glycine transporter 1, isoform 3 | SEQ ID NO: 96 |
| SLC6A10 | sodium- and chloride-dependent creatine transporter 2 | SEQ ID NO: 97 |
| SLC6A11 | sodium- and chloride-dependent GABA transporter 3 | SEQ ID NO: 38 |
| SLC6A12 | sodium- and chloride-dependent betaine transporter | SEQ ID NO: 43 |
| SLC6A13 | sodium- and chloride-dependent GABA transporter 2 | SEQ ID NO: 37 |
| SLC6A14 | Sodium- and chloride-dependent neutral and basic amino acid transporter B(0+) | SEQ ID NO: 98 |
| SLC6A15 | Orphan sodium- and chloride-dependent neurotransmitter transporter NTT73 | SEQ ID NO: 99 |
| SLC6A16 | Orphan sodium- and chloride-dependent neurotransmitter transporter NTT5 | SEQ ID NO: 100 |
| SLC6A17 | Orphan sodium- and chloride-dependent neurotransmitter transporter NTT4 | SEQ ID NO: 101 |
| SLC6A18 | Sodium- and chloride-dependent transporter XTRP2 | SEQ ID NO: 102 |
| SLC6A19 | Sodium-dependent neutral amino acid transporter B(0) | SEQ ID NO: 103 |
| SLC6A20 | Sodium- and chloride-dependent transporter XTRP3 | SEQ ID NO: 104 | a. Norepinephrine Transporter

The norepinephrine transporter (NET) is a sodium chloride-dependent neurotransmitter symporter located primarily on the plasma membrane of noradrenergic neurons that removes norepinephrine (NE) from the extracellular space by high affinity reuptake into presynaptic terminals. NET also is referred to as the "sodium-dependent noradrenaline transporter," "noradrenaline:$Na^+$ symporter," "SLC6A2," "TC 2.A.22.1.2" and "solute carrier family 6 (neurotransmitter transporter, noradrenalin), member 2." The NET not only regulates the longevity of norepinephrine in the synapse but also plays an important role in presynaptic and postsynaptic homeostasis. The norepinephrine transporter belongs to NET is a monoamine transporter which, like other monoamine transporters such as the dopamine transporter (DAT) and the serotonin transporter (SAT), transfers monoamine neurotransmitters in and out of cells.

i. Structure

The norepinephrine transporter (NET) is encoded by the SLC6A2 gene. The cloned human NET cDNA (Pacholcznyk et al. (1991) Nature 350:350-354) is an 1857 base pair open reading frame (SEQ ID NO:25) encoding a 617 amino acid polypeptide (SEQ ID NO:26) with 12 transmembrane domains. The human NET shows sequence and structural similarity to norepinephrine transporters from other species including, but not limited to, bovine (SEQ ID NO:27, mouse (SEQ ID NO:28), rat (SEQ ID NO:29), rhesus macaque (SEQ ID NO:30), chicken (SEQ ID NO:31), ovine (fragment) (SEQ ID NO:32) and Japanese quail (SEQ ID NO:33). In addition to multiple single amino acid variants, such as those set forth in SEQ ID NOS:45-60, there are three known C-terminal isoforms of human NET resulting from alternative splicing. Typically, exon 14 of the human NET gene encodes the last 7 amino acids of the 617 amino acid polypeptide (SEQ ID NO:26). In the two additional variants, alternative splicing joins exon 13 to a new exon 15 (skipping exon 14). The alternatively spliced exon 15 encodes for either 3 or 18 amino acids, resulting in polypeptides with a sequence set forth in SEQ ID NOS: 61 and 62, respectively (Distelmaier et al., (2004) J. Neurochem. 91: 537-546). It has been observed that while there was no difference in the binding abilities of these isoforms, expression of the long C-terminal NET splice variant (SEQ ID NO:62) exerted a dominant negative effect on cell surface expression of the wild-type 617 amino acid NET. It has been postulated, therefore, that this isoform may be involved in a mechanism for a regulating noradrenergic neurotransmission (Distelmaier et al., (2004) J. Neurochem. 91: 537-546).

Like other sodium/neurotransmitter symporter family members, the human NET protein contains 12 hydrophobic segments, each of 18-25 amino acids in length, forming the transmembrane domains (TM1 to TM12). The amino and carboxy termini are located in the cytoplasmic space. There are three possible N-glycosylation sites located on the extracellular loop between TM3 and TM4 at amino acid positions 184, 192 and 198 of SEQ ID NO:26). N-linked glycosylation of NET results in increased cellular expression of the transporter (Nguyen et al., (1996) J. Neurochem. 67:645-655, Melikian et al., (1996) Mol Pharmacol. 50:266-276).

ii. Function

Human NET is expressed almost exclusively in the central and peripheral sympathetic nervous system on the plasma membrane of noradrenergic neurons, where it functions to take up synaptically released norepinephrine. NET mRNA expression is localized to monoaminergic cell bodies rather than to nerve terminals and is generally restricted to cells that synthesize the corresponding NE. As such, NET mRNA expression in the brain is an indicator for noradrenergic pathways with cell bodies primarily located in the brain stem, and in the locus coeruleus complex in the dorsal pons, particularly in the nucleus locus coeruleus proper. NET mRNA also is expressed in the lateral tegmentum of the medulla and pons. All these regions encompass most of the noradrenergic cell bodies in the CNS. In the periphery, NET mRNA is expressed in sympathetic ganglia, in the adrenal medulla and the placenta (Bönisch H and Brüss M. (2006) Handb Exp Pharmacol. 175:485-524).

NET acts as the primary mechanism for the inactivation of noradrenergic signaling. Norepinephrine, also known as noradrenaline, is a neurotransmitter found in the sympathetic nervous system and is an important neurochemical messenger in the central nervous system, playing a crucial role in physiology and pathology. NE is involved in mood regulation, sleep regulation, expression of behavior, memory, and the extent of alertness and arousal. NE also exerts control over the endocrine system and autonomic nervous system, and is involved in the regulation of heart rate and blood pressure. Reuptake of NE by NET is the primary mechanism by which the biological effects of NE in the synapse are terminated. Thus, NET is critical in preventing excessive increases of NE concentrations in the synaptic cleft, which regulate adrenergic neurotransmission in the brain as well as the removal of NE from the heart and other peripheral organs (Tellioglu et al. (2001) Expert Rev. Mol. Med. 19 November). Approximately 70-90% of the NE released into the synapses is cleared by this mechanism, while the remaining 10-30% leaks out into the circulation or extraneuronal tissue (Esler et al. (1990) Physiol. Rev. 70:963-985).

In addition to the transport of NE, the norepinephrine transporter also has been shown in vitro using human NET-transfected cells to transport other substrates, including, but not limited to, dopamine, epinephrine, metaraminol, tyramine, phenylethylamine, d-amphetamine, ephedrine and serotonin, in addition to other substances including, but not limited to, the drugs tranylcypromine, selegiline and amezinium, the adrenergic neuron blocking agents bretylium and guanethidine, meta-iodobenylguanadine (MIBG), the covalently binding NET suicide substrates and noradrenergic neurotoxins xylamine, and DSP-4, the dopaminergic neurotoxin 1-methyl-4-tetrahydropyridinium) $MPP^+$ and the fluorescent model substrate $ASP^+$ (Bönisch H and Brüss M. (2006) Handb Exp Pharmacol. 175:485-524). In addition to binding substrates, NET also binds various molecules that act as inhibitors, including, but not limited to, antidepressants such as desipramine, nortriptyline, reboxetine, maprotiline and nomifensine, and other substances such as nisoxetine, sibutramine, atomoxetine, RTI-55 and cocaine (Bönisch H and Brüss M. (2006) Handb Exp Pharmacol. 175:485-524).

Substrate transport by the NET is dependent on $Na^+$ and $Cl^-$ ions and the $Na^+$ gradient across the plasma membrane that drives the intracellular accumulation of the substrate. Studies indicate that sequential binding of $Na^+$ and then $Cl^-$ is required for substrate binding to the transporter (Bönisch H and Brüss M. (1994) Ann. N.Y. Acad. Sci. 733:193-202). Following binding of the substrate, both $Na^+$ and $Cl^-$ are co-transported with the substrate into the cytoplasm. The ion pump $Na^{+-}/K^+$-ATPase is the driving force for this transport by maintaining a $Na^+$ concentration gradient across the plasma membrane. $Na^+$ and $Cl^-$ dependent transport of NE and other substrates into the cytoplasm also requires a balance of $K^+$ ions across the cell membrane.

2. The Sodium Glucose Cotransporter Family

Exemplary of transporters for use in the viruses and methods described herein are members of the sodium glucose cotransporter family (Solute carrier family 5; SLC5), also known as the sodium/solute symporter family (SSSF) or TC 2.A.21. This family has over a hundred members of prokaryotic and eukaryotic origin. The family members typically have 11 to 15 transmembrane domains (TMs) in alpha-helical conformation. Proteins of this family utilize a sodium motive force (the energy stored in an inwardly directed electrochemical sodium gradient) to drive uphill transport of substrates such as sugars, amino acids, vitamins, ions, myo-inositol, phenyl acetate, urea, and water. Most of the transporters are part of catabolic pathways and are used by the cells to acquire the corresponding substrate. Among the best characterized members of the SSSF are the human sodium/glucose transporter (SGLT1), the sodium/iodide transporter (NIS), and PutP of E. coli. Table 4 sets forth the gene name of exemplary members of the SLC5 family, the corresponding protein name and the sequence identifier of the corresponding human protein.

TABLE 4

SLC5 family members

| SLC5 gene | Protein name | SEQ ID NO: |
|---|---|---|
| SLC5A1 | sodium/glucose cotransporter 1 | SEQ ID NO: 69 |
| SLC5A2 | sodium/glucose cotransporter 2 | SEQ ID NO: 70 |
| SLC5A3 | sodium/myo-inositol cotransporter | SEQ ID NO: 71 |
| SLC5A4 | low affinity sodium-glucose cotransporter | SEQ ID NO: 72 |
| SLC5A5 | sodium/iodide cotransporter | SEQ ID NO: 63 |
| SLC5A6 | sodium-dependent multivitamin transporter | SEQ ID NO: 73 |
| SLC5A7 | high affinity choline transporter 1 | SEQ ID NO: 74 |
| SLC5A8 | sodium-coupled monocarboxylate transporter 1 | SEQ ID NO: 75 |
| SLC5A9 | sodium/glucose cotransporter 4 | SEQ ID NO: 76 |
| SLC5A10 | sodium/glucose cotransporter 5, isoform 1 | SEQ ID NO: 77 |
|  | sodium/glucose cotransporter 5, isoform 2 | SEQ ID NO: 78 |
|  | sodium/glucose cotransporter 5, isoform 3 | SEQ ID NO: 79 |
|  | sodium/glucose cotransporter 5, isoform 4 | SEQ ID NO: 80 |
| SLC5A11 | sodium/myo-inositol cotransporter 2, isoform 1 | SEQ ID NO: 81 |
|  | sodium/myo-inositol cotransporter 2, isoform 2 | SEQ ID NO: 82 |
|  | sodium/myo-inositol cotransporter 2, isoform 3 | SEQ ID NO: 83 |
|  | sodium/myo-inositol cotransporter 2, isoform 4 | SEQ ID NO: 84 |
| SLC5A12 | sodium-coupled monocarboxylate transporter 2, isoform 1 | SEQ ID NO: 85 |
|  | sodium-coupled monocarboxylate transporter 2, isoform 2 | SEQ ID NO: 86 | a. Sodium Iodide Symporter

The sodium-iodide symporter (NIS) is an ion pump that transports iodide ($I^-$) into thyroid epithelial cells across the basolateral plasma membrane, an important step in the process of iodide organification and the formation of triiodothyronine ($T_3$) and thyroxine ($T_4$). NIS also is referred to as the "Sodium/iodide cotransporter," "Na(+)/I(−) cotransporter," "SLC5A5," "TC 2.A.21.5.1" and "solute carrier family 5 member 5."

i. Structure

The human sodium-iodide symporter gene (SLC5A5) encodes a glycoprotein of 643 amino acids (SEQ ID NO:63) with a molecular mass of approximately 70-90 kDa. The gene has 15 exons and has an open reading frame of 1929 nucleotides (SEQ ID NO:64). The NIS is predicted to have a 13-transmembrane segment pattern with the N-terminus facing the extracellular milieu, and the COOH-terminus facing the cytosol (Levy et al. (1997) Proc. Nat. Acad. Sci. 94: 5568-5573.). The human NIS shares sequence and structural similarity to NIS proteins from other species, including but not limited to, the NIS from mouse (SEQ ID NO:65), rat (SEQ ID NO:66), Zebrafish (SEQ ID NO:67), and African clawed frog mouse (SEQ ID NO:68). Multiple natural variants of human NIS also exist, including, but not limited to, those set forth in SEQ ID NOS:87-94). Synthetic variants of hNIS also are available and include hNIS transporters with multiple lysine residues inserted at that C-terminus of the protein (see, e.g., PCT Patent publication 2004/000236), which increases the net positive electrostatic charge of the protein, allowing increased transport of NIS substrates.

There are at least two potential sites of glycosylation in the human NIS at amino acid positions 489, 502 of SEQ ID NO:63. However, studies using rat NIS indicate that glycosylation does not play an important role in the stability, activity, or targeting to the membrane of the symporter (Levy et al., (1998) J. Biol. Chem. 273: 22657-22663). NIS also a phosphoprotein (Riedel et al. (2001) J. Biol. Chem. 276: 21458-21463). Amino acid position 556 of the human NIS polypeptide set forth in SEQ ID NO:63 is a potential site for phosphorylation by phosphokinase A (PKA).

ii. Function

The NIS is an intrinsic transmembrane protein that is expressed on the basolateral membrane of thyroid follicular cells and mediates the accumulation of iodide from the bloodstream to thyroid follicles as the crucial first step for thyroid hormone biosynthesis. The thyroid hormones $T_3$ and $T_4$ are the only iodine-containing hormones in vertebrates. Because F is an essential constituent of $T_3$ and $T_4$, thyroid function depends on an adequate supply of F to the gland. In normal thyroid tissue, NIS transports $Na^+I^-$ ions at a 2:1 stoichiometry down the $Na^+$ ion gradient that generated from the activity of $Na^+/K^+$ ATPase. NIS actively transports iodide producing an iodine concentration gradient from the thyroid cell to extracellular fluid greater than 30:1. This process is stimulated by thyrotropin (TSH) and inhibitable by the competitive inhibitors thiocyanate ($SCN^-$) and perchlorate ($ClO_4^-$). $I^-$ is then translocated from the cytoplasm across the apical plasma membrane toward the colloid in a process called $I^-$ efflux. $I^-$ is oxidized and incorporated into tyrosyl residues within the thyroglobulin (Tg) molecule, leading to the subsequent coupling of iodotyrosine residues at the cell-colloid interface. This process is called organification of $I^-$. Iodinated Tg is stored extracellularly in the colloid. In response to demand for thyroid hormones, phagolysosomal hydrolysis of endocytosed iodinated Tg is effected. $T_3$ and $T_4$ are secreted into the bloodstream, and nonsecreted iodotyrosines are metabolized to tyrosine and $I^-$ (Dohan et al. (2003) Endocrine Reviews 24:48-77).

The human NIS also is expressed in extrathyroidal tissues, including the salivary gland, gastric mucosa, mammary gland, ciliary body of the eye, and the choroid plexus. Thus, NIS also mediates active $I^-$ transport in other tissues, including salivary glands, gastric mucosa, and lactating mammary gland, although this process is not stimulated by TSH in these tissues (Dohan et al. (2003) Endocrine Reviews 24:48-77). Whereas the functional significance of NIS in the gastric mucosa and salivary glands is unknown, in the lactating mammary gland NIS mediates the translocation of $I^-$ into the milk, making this anion available for the nursing newborn to biosynthesize his/her own thyroid hormones. Studies using whole body imaging with radioiodide indicate that lactating breast tissue concentrates a significant amount of iodide as a result of stimulation of NIS expression. The trapped iodide is secreted in milk and provides iodine for thyroid hormone synthesis to the developing infant (Kogai et al., (2006) Endocrine-Related Cancer 13:797-826).

The ability of the thyroid to accumulate $I^-$ via NIS has enabled diagnostic scintigraphic imaging of the thyroid with radioiodide and has served as an effective means for therapeutic doses of radioiodide to target and destroy hyperfunctioning thyroid tissue, such as in Graves' disease and $I^-$-transporting thyroid cancer and its metastases. The expression of NIS on various thyroid tumors can differ. For example, in some studies, reduced expression of NIS mRNA and protein was been observed in papillary and follicular thyroid cancer, while other studies indicated increased NIS expression in papillary (Kogai et al., (2006) Endocrine-Realted Cancer 13:797-826). In addition to being expressed on thyroid tumors, NIS expression has been demonstrated in more than 80% of breast cancer tissue (Wapnir et al. (2003) J. Clin. End. Met. 88: 1880-1888). As a result, agents that stimulate NIS expression in breast cancer sufficient to concentrate radioiodide have been considered as a source of potential therapy for some differentiated breast cancer (Boelaert et al. (2003) Lancet 361: 796-797).

In addition to transporting $I^-$ ions, studies have indicated that NIS also can transport additional anions, including, but not limited to, $ClO_3^-$, $SCN^-$, $SeCN^-$, $NO_3^-$, $BR^-$, $BF_4^-$, $IO_4^-$ and $BrO_3^-$, $ClO_3^-$, $ReO_4^-$, $At^-$, $TcO_4^-$ (Van Sande et al., (2003) Endocrinology 144:247-52, International Patent Publication WO2004000236). Such substrates can be administered to patients in chemical forms well known in the art for therapeutic or imaging purposes. For example, $I^-$ can be administered as NaI, $TcO_4^-$ can be administered as $Na^+$ ($TcO_4^-$). In some instances, the NIS substrates used in the methods herein and other methods for imaging o therapy are isotopic and include radionuclides. For example, $^{123}I$, $^{124}I$, $^{125}I$ and $^{131}I$ are forms of isotopic radioactive iodide, $^{99m}TcO_4$ is a form of isotopic pertechnate, $^{188}ReO_4$ is an isotopic form of perrhenate and $^{211}At$ is an isotopic form of astatide.

D. Methods of Assessing Modified Viruses Encoding Transporters

The activity of transporters used in the viruses and methods herein, and the ability of the modified viruses to deliver and express these transporters on infected cells, can be assayed using methods well known in the art. The ability of transporters to transport one or more substrates can be assessed prior to expression in a modified virus, such as by transfection of cell lines with nucleic acid encoding the transporter of interest, to assist in determining suitable transporters for inclusion in the modified viruses. The activity of the transporters also can be assessed in the context of a modified virus, such as any of those provided herein. The transporters can be assessed, for example, to determine the expression profile, including the cellular localization and level of expression, on a cell following infection with the modified virus that expresses the transporter. In addition, the ability of virus to produce high levels of expression of the transporter in tumor tissue can be assessed to determine whether the expressed transporter can concentrate the signals emitted by the transporter substrates at the tumor tissue. The specificity of the transporter, such as the ability of the transporter to transport one or more substrates, and level of activity, such as how much substrate is transported, can be assessed. Such assays are available and know by those skill in the art. Exemplary assays are provided herein.

1. In Vitro Assessment

The expression of transporters on cells infected by modified viruses carrying those transporters, such as those viruses described herein, can be assessed using assays well known in the art. In some instances, immunoassays can be used to assess the expression of transporters on cells following infection with the modified viruses. For example, modified viruses encoding a transporter can be used to infect cells and the level of expression determined by immunoblot with a transporter-specific antibody following cell lysis (see e.g. Example 2.C, below). Alternatively, the cell lysates could be analyzed by enzyme-linked immunosorbant assays (ELISA) to assess transporter expression. In another example, infected cells are analyzed by, for example, immunohistochemistry, flow cytometry analysis or immunoprecipitation using transporter-specific antibodies.

Assays to determine the cellular localization of a transporter following infection with a modified virus encoding the transporter also are known in the art and can be used herein. For example, techniques such as immunocytochemistry and cell surface biotinylation can be used to determine the localization of transporters such as NET, NIS and GABA transporters (Gu et al., (2001) Mol. Cell Biol. 12:3797-3807, Ahn et al., (1996) J. Biol. Chem. 27: 6917-6924, Gu et al. (1996) J. Biol. Chem. 271, 18100-18106, Dayem et al., (2008) J. Endocrinol. 197:95-109).

The ability of transporters to bind and transport substrates across a membrane can be assessed in vitro using any one or more assays known in the art. In some instances, radiotracer assays are used to assess transporter activity (such as those described in Example 2.D, below. Such assays can be performed prior to introducing the nucleic acid encoding the transporter into the modified viruses. This can be done, for example, to screen transporters for substrate specificity to assist in determining which transporters are suitable for use in the viruses and methods herein. For example, nucleic acid encoding the transporter can be stably or transiently transfected, or can be introduced using viral vectors, into an appropriate cell line (see e.g. Moroz et al., (2007) J Nucl. Med. 48:827-836) and a radiotracer assay performed. Alternatively, the modified virus expressing the transporter can be used to infect an appropriate cell line, such a tumor cell line, such as described in Example 2.D. The amount of radiolabeled substrate that is transported into the cell is then assessed, such as by using a gamma counter, to determine whether the transporter is specific for the substrate and, if so, how efficient the transporter is in transporting the substrate. Many radiolabeled substrates are readily available, and methods for radiolabeling substrates also are well known in the art and can be used in the methods herein to label a desired substrate for use in a radiotracer assay. Isotopic labels can be incorporated at specific positions of a compound and can be incorporated into peptides and polypeptides and other substances (see e.g. U.S. Pat. No. 5,102,651, 5,277,893, U.S. Patent Publication No. 20070280883, Sandell et al., (2002) Bior. Med. Clin. Lett. 14:3611-3613). Such assays can be performed using cells infected with modified viruses encoding the transporter and cells infected with modified viruses that do not encode the transporter. The level by which substrate uptake is increased when the transporter is expressed can then be determined.

Other assays to detect transport of substrates are known in the art and can be used herein. In some instances, these assays utilize fluorescent substrates. For example, the fluorescent substrate 4-(4-dimethylaminostyryl)-N-methylpyridinium ($ASP^+$) can be used to detect transporting activity of NET (see e.g. U.S. Patent Publication No. 2004115703, International Pat. Pub. WO2008043851, Hauns (2007) J. Biomol. Screen. 12:378-384). Other fluorescent substrates can be used to detect the activity or neurotransmitter transporters (International Pat. Pub. WO2008021870). Fluorescent-based assays also are known for other transporters, including, but not limited to, NIS (see e.g. Rhoden et al., (2007) Am. J. Physiol. 61:C814-C823). Other methods for identifying substrates specific for transporters are known in the art and can be used herein (see e.g. U.S. Pat. No. 7,309,576, European Patent No EP1212616).

2. In Vivo Assessment

The modified viruses encoding transporters also can be assessed in vivo, both in human and animal models. Animal models, such as mouse models, of different types of human and non-human animal cancers can be employed to assess the transporter activity imparted by infection with the modified viruses. Tumors can be established by implantation of different tumor cell types. Exemplary human tumor xenograft models in mice, such as nude or SCID mice, include, but are not limited to, human lung carcinoma (A549 cells, ATCC No. CCL-185); human breast tumor (GI-101A cells, Rathinavelu et al., *Cancer Biochem. Biophys.*, 17:133-146 (1999)); human ovarian carcinoma (OVCAR-3 cells, ATCC No. HTB-161); human pancreatic carcinoma (PANC-1cells, ATCC No. CRL-1469 and MIA PaCa-2 cells, ATCC No. CRL-1420); DU145 cells (human prostate cancer cells, ATCC No. HTB-81); human prostate cancer (PC-3 cells, ATCC# CRL-1435); colon carcinoma (HT-29 cells); human melanoma (888-MEL cells, 1858-MEL cells or 1936-MEL cells; see e.g. Wang et al., (2006) *J. Invest. Dermatol.* 126:1372-1377); and human fibrosarcoma (HT-1080 cells, ATCC No. CCL-121,) and human mesothelioma (MSTO-211H cells).

The ability of the virus to deliver the transporter to the tumor and for the transporter to be subsequently expressed and be active can be assessed using such models (see e.g. Example 3, below). For example, transporter expression can be detected using methods such as immunohistochemistry, immunoblot and flow cytometry analysis of tumor and non-tumor tissues using transporter-specific antibodies. The activity of the transporter also be assessed using, for example, radiolabeled or fluorescently labeled substrate. Whole animal imaging can be then performed, such as PET or gamma imaging (see e.g. Example 3.B and C, below) to detect the transport and accumulation of the labeled substrate in the tumor cells. In other examples, tissues from the mouse can be extracted and the radiolabeled or fluorescently labeled substrate can be detected by, for example, imaging, flow cytometry, gamma counting or fluorescent microscopy.

In some instances, the radiolabeled substrate also can be a chemotherapeutic agent or can be linked to a therapeutic agent. Thus, the therapeutic effect of transport of the agent into the tumor cell also can be assessed in animal models. For example, the change in tumor growth can be assessed following injection with a modified virus encoding a transporter/chemotherapeutic agent and compared with tumor growth following injection with a modified virus that does not encode the transporter.

3. Selection of Substrates

Substrates that can be transported into cells by particular transporter proteins are known in the art and can be selected for use as imaging and/or therapeutic agents. The substrates can be radiolabeled for detection in vivo by imaging methods, including PET and SPECT imaging and other imaging methods as described elsewhere herein. The radiolabeled substrates can be employed for either or both imaging and therapy of tumors. For example, the accumulation of radioactive substrates within infected tumor cells that express the corresponding transporter proteins can provide radiotherapy treatment of the tumor.

Exemplary detectable substrates that can be selected for transport by norepinephrine, dopamine and serotonin transporters include, but are not limited to, radiolabeled metaiodobenzylguanidine (MIBG), such as $^{124}$I-MIBG and $^{123}$I-MIBG $^{131}$-MIBG and $^{11}$C-labeled hydroxyephedrine (HED) (Shulkin et al. (1986) *J Nucl Med* 27:1138-42 and Glowniak et al. (1993) *J Nucl Med* 34:1140-6). Exemplary detectable substrates that can be selected for transport by hNIS include, but are not limited to radioactive iodide ($^{123}$I$^-$, $^{124}$I$^-$ and $^{131}$I$^-$), other radiolabeled anions ($^{99m}$TcO$_4^-$ (pertechnetate), $^{76}$Br$^-$), the β-emitter $^{188}$rhenium ($^{188}$ReO$_4^-$) and the α-emitter $^{211}$astatine ($^{211}$At$^-$) (Van Sande et al. (2003) *Endocrinology* 144:247-52; Barton et al. (2003) *Mol Ther* 8:508-18; Kang et al. (2004) *J Nucl Med* 45:1571-6; Cho et al. (2002) *Gene Ther* 9:1139-45; Groot-Wassink et al. (2004) *Mol Ther* 9:436-42; Niu et al. (2004) *J Nucl Med* 45:445-9; Groot-Wassink et al. (2002) *Hum Gene Ther* 13:1723-35; Shimura et al. (1997) *Endocrinology* 138:4493-6; Mandell et al. (1999) *Cancer Res* 59:661-8; Boland et al. (2000) *Cancer Res* 60:3484-92; Carlin et al. (2002) Nucl Med Biol 29:729-39; Haberkorn et al. (2003) *Gene Ther* 10:774-80). hNIS can also transport anions such as ClO$_3^-$, SCN$^-$, SeCN$^-$, NO$_3^-$, Br$^-$, BF$_4^-$, IO$_4^-$ and BrO$_3^-$ that can be labeled according to methods known in the art (Van Sande et al. (2003) *Endocrinology* 144:247-52).

Selected substrates can also be conjugated to cytotoxic agents for therapy tumors. Uptake of the transporter substrates thus permits accumulation of the cytotoxic agent in the infected tumors that express the transporter. The accumulation also results in high levels of the cytotoxic agents in the surrounding tumorous tissue, thus promoting uptake of the cytotoxic agents by neighboring tumor cells. Such cytotoxic agents for the therapy of tumor are know in the art and include, but are not limited to, double-chain ricin, ricin A chain, abrin, abrin A chain, saporin, modeccin, modeccin A chain, *Pseudomonas aeruginosa* exotoxin, *Cholera* toxin, *Shigella* toxin, *E. coli* heat labile toxin and Diptheria toxin, doxorubicin, daunomycin, 5-fluorouracil, methotrexate, taxol, ricin A, colchicine, cytochasins, monensin, ouabain, mitoxanthrone, vindesine, vinblastine, vincristine or enterotoxin

E. Additional Modifications of Viruses Provided

Viruses provided herein that encode a transporter protein can contain additional modifications. Such modifications can be generated using any known method for modifying a virus. The additional modifications of the virus can be introduced prior to, simultaneously with or following modification of the viral genome to introduce DNA encoding the transporter protein. Furthermore, viruses provided herein also can be further modified to attenuate the virus. Hence, the methods provided herein can be combined with any known method for modifying a virus. Furthermore, the methods provided herein can be combined with any known method for modulating the attenuation of a virus. For example, such methods include modification of one or more viral genes, such as by a point mutation, a deletion mutation, an interruption by an insertion, a substitution or a mutation of the viral gene promoter or enhancer regions.

Viruses provided herein can contain one or more additional heterologous nucleic acid molecules inserted into the genome of the virus. A heterologous nucleic acid molecule can contain an open reading frame or can be a non-coding sequence. In some cases, the heterologous nucleic acid replaces all or a portion of a viral gene.

Further modifications of the viruses provided can enhance one or more characteristics of the virus. Such characteristics can include, but are not limited to, attenuated pathogenicity, reduced toxicity, preferential accumulation in tumor, increased ability to activate an immune response against tumor cells, increased immunogenicity, increased or decreased replication competence, and ability to express additional exogenous proteins, and combinations thereof. In some examples, the modified viruses have an ability to activate an immune response against tumor cells without aggressively killing the tumor cells. In other examples, the viruses can be modified to express one or more detectable gene products, including additional gene products that can be used for imaging. In other examples, the viruses can be modified to express one or more genes for the therapy of a tumor or an inflamed or wounded tissue. In other examples, the viruses can be modified to express one or more genes for harvesting the gene products and/or for harvesting antibodies against the gene products.

1. Modification of Viral Genes

Methods for modifying a virus include modifications in one or more viral genes. Modification can include those that inactivate viral gene or abolish or decrease the activity of a viral gene product. In some example the viral gene is replaced with non-coding nucleic acid. Such modifications in a viral gene can alter the viral processes, such as, for example, viral infectivity, viral DNA replication, viral protein synthesis, virus particle assembly and maturation, and viral particle release. Exemplary viral genes for modification include, but are not limited to, viral surface antigens (e.g. proteins that mediate viral attachment to host cell receptors), viral proteases, and viral enzymes involved in viral replication and transcription of viral genes (e.g., polymerases, replicases and helicases). Modifications in such genes can decrease the overall replication of the virus and production of viral particles thus resulting in a more attenuated virus.

In some examples, the viral gene can be replaced with homologous gene from another virus or a different gene. For example, vaccinia viruses provided herein can be modified by replacement of the A34R gene with another A34R gene from a different strain in order to increase the EEV form of the virus. In one example, the A34R gene from the Lister strain of vaccinia can be replaced with A34R gene from the IHD-J strain of vaccinia virus In another embodiment, a viral surface antigen gene can be modified to produce a chimeric protein such that the heterologous epitope is expressed on the surface of the virus. Viruses expressing such chimeric proteins are thus useful as vaccines for use in generating an immune response in the host subject. Exemplary epitopes include but are not limited to tumor antigens, viral and bacterial antigens. Many exemplary antigens are known in the art, and include, for example, those listed and/or described in Novellino et al. (2005) *Cancer Immunol Immunother.* 54(3):187-207; Eisenberger et al. (2006) *Hematol Oncol Clin North Am.* 20(3):661-87. In one embodiment, insertion of a heterologous epitope into the viral gene can affect the level of attenuation of the virus. In an alternative embodiment, the level of attenuation of the virus is unaffected by insertion of a heterologous epitope into the viral gene.

2. Expression of Additional Heterologous Genes

Viruses provided herein and viruses generated using the methods provided herein can be further modified to express one or more additional heterologous genes. Gene expression can include expression of a protein encoded by a gene and/or expression of an RNA molecule encoded by a gene. In some embodiments, the viruses can express heterologous genes at levels high enough that permit harvesting products of the heterologous gene from the tumor.

The heterologous nucleic acid can be operably linked to a promoter for expression of an open reading frame encoding the heterologous protein. Expression of heterologous genes can be controlled by a constitutive promoter, or by an inducible promoter. Expression can also be influenced by one or more proteins or RNA molecules expressed by the virus. Gene regulatory elements, such as promoters and enhancers, possess cell type specific activities and can be activated by certain induction factors (e.g., hormones, growth factors, cytokines, cytostatics, irradiation, heat shock) via responsive elements. A controlled and restricted expression of these genes can be achieved using such regulatory elements as internal promoters to drive the expression of therapeutic genes in viral vector constructs. Heterologous genes expressed can include genes encoding a therapeutic gene product, genes encoding a detectable gene product, such as a gene product that can be used for imaging, genes encoding a gene product to be harvested, genes encoding an antigen of an antibody to be harvested or to elicit an immune response. The viruses provided herein can be used for expressing genes in vivo and in vitro. Exemplary proteins include reporter proteins (*E. coli* β-galactosidase, β-glucuronidase, xanthineguanine phosphoribosyltransferase), proteins facilitating detection, such as a detectable protein or a protein capable of inducing a detectable signal, (luciferase, fluorescent proteins, transferrin receptor, for example), gene products (i.e., proteins and RNAs) useful for tumor therapy (e.g., a transporter, a cell-surface receptor, a cytokine, a chemokine, an apoptotic protein, a mitosis inhibitor protein, an antimitotic oligopeptide, an antiangiogenic factor, anti-cancer antibodies, such as a single-chain antibody, a toxin, a tumor antigen, a prodrug converting enzyme, a ribozyme, RNAi, siRNA, *pseudomonas* A endotoxin, *diphtheria* toxin, p53, Arf, Bax, tumor necrosis factor-alpha, HSV TK, *E. coli* purine nucleoside phosphorylase, angiostatin and endostatin) and other anticancer or therapeutic gene products.

a. Detectable Gene Product

Viruses provided herein and viruses generated using the methods provided herein can express one or more genes whose products are detectable or whose products can provide a detectable signal. A variety of detectable gene products, such as detectable proteins are known in the art, and can be used with the viruses provided herein. Detectable proteins include receptors or other proteins that can specifically bind a detectable compound, proteins that can emit a detectable signal such as a fluorescence signal, and enzymes that can catalyze a detectable reaction or catalyze formation of a detectable product.

In some embodiments, the virus expresses a gene encoding a protein that can emit a detectable signal or that can catalyze a detectable reaction. A variety of DNA sequences encoding proteins that can emit a detectable signal or that can catalyze a detectable reaction, such as luminescent or fluorescent proteins, are known and can be used in the viruses and methods provided herein. Exemplary genes encoding light-emitting proteins include genes from bacterial luciferase from *Vibrio harveyi* (Belas et al., *Science* 218 (1982), 791-793), bacterial luciferase from *Vibrio fischerii* (Foran and Brown, *Nucleic acids Res.* 16 (1988), 177), firefly luciferase (de Wet et al., *Mol. Cell. Biol.* 7 (1987), 725-737), aequorin from *Aequorea victoria* (Prasher et al., *Biochem.* 26 (1987), 1326-1332), *Renilla* luciferase from *Renilla renformis* (Lorenz et al, *PNAS USA* 88 (1991), 4438-4442) and green fluorescent protein from *Aequorea victoria* (Prasher et al., *Gene* 111: 229-233 (1987)). The luxA and luxB genes of bacterial luciferase can be fused to produce the fusion gene ($Fab_2$), which can be expressed to produce a fully functional luciferase protein (Escher et al., *PNAS* 86: 6528-6532 (1989)). Transformation and expression of these genes in viruses can permit detection of viral infection, for example, using a low light and/or fluorescence imaging camera. In some embodiments, luciferases expressed by viruses can require exogenously added substrates such as decanal or coelenterazine for light emission. In other embodiments, viruses can express a complete lux operon, which can include proteins that can provide luciferase substrates such as decanal. For example, viruses containing the complete lux operon sequence, when injected intraperitoneally, intramuscularly, or intravenously, allowed the visualization and localization of microorganisms in live mice indicating that the luciferase light emission can penetrate the tissues and can be detected externally (Contag et al. (1995) *Mol. Microbiol.* 18: 593-603).

In other embodiments, the virus can express a gene that can bind a detectable compound or that can form a product that can bind a detectable compound. A variety of gene products, such as proteins, that can specifically bind a detectable compound are known in the art, including receptors, metal binding proteins (e.g., siderophores, ferritins, transferrin receptors), ligand binding proteins, and antibodies. Any of a variety of detectable compounds can be used, and can be imaged by any of a variety of known imaging methods. Exemplary compounds include receptor ligands and antigens for antibodies. The ligand can be labeled according to the imaging method to be used. Exemplary imaging methods include any of X-rays, a variety magnetic resonance methods such as magnetic resonance imaging (MRI) and magnetic resonance spectroscopy (MRS), and also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography and ultrasonic tomography.

Labels appropriate for X-ray imaging are known in the art, and include, for example, Bismuth (III), Gold (III), Lanthanum (III) or Lead (II); a radioactive ion, such as $^{67}$Copper, $^{67}$Gallium, $^{68}$Gallium, $^{111}$Indium, $^{113}$Indium, $^{123}$Iodine, $^{125}$Iodine, $^{131}$Iodine, $^{197}$Mercury, $^{203}$Mercury, $^{186}$Rhenium, $^{188}$Rhenium, $^{97}$Rubidium, $^{103}$Rubidium, $^{99}$Technetium or $^{90}$Yttrium; a nuclear magnetic spin-resonance isotope, such as Cobalt (II), Copper (II), Chromium (III), Dysprosium (III), Erbium (III), Gadolinium (III), Holmium (III), Iron (II), Iron (III), Manganese (II), Neodymium (III), Nickel (II), Samarium (III), Terbium (III), Vanadium (II) or Ytterbium (III); or rhodamine or fluorescein.

Labels appropriate for magnetic resonance imaging are known in the art, and include, for example, gadolinium chelates and iron oxides. Use of chelates in contrast agents is known in the art. Labels appropriate for tomographic imaging methods are known in the art, and include, for example, β-emitters such as $^{11}$C, $^{13}$N, $^{15}$O or $^{64}$Cu or (b) γ-emitters such as $^{123}$I. Other exemplary radionuclides that can, be used, for example, as tracers for PET include $^{55}$Co, $^{67}$Ga, $^{68}$Ga, $^{60}$Cu (II), $^{67}$Cu(II), $^{57}$Ni, $^{52}$Fe and $^{18}$F (e.g., $^{18}$F-fluorodeoxyglucose (FDG)). Examples of useful radionuclide-labeled agents are $^{64}$Cu-labeled engineered antibody fragment (Wu et al. (2002) *PNAS USA* 97: 8495-8500), $^{64}$Cu-labeled somatostatin (Lewis et al. (1999) *J. Med. Chem.* 42: 1341-1347), $^{64}$Cu-pyruvaldehyde-bis (N4methylthiosemicarbazone)(64Cu-PTSM) (Adonai et al. (2002) *PNAS USA* 99: 3030-3035), $^{52}$Fe-citrate (Leenders et al. (1994) *J. Neural. Transm. Suppl.* 43: 123-132), $^{52}$Fe/$^{52m}$Mn-citrate (Calonder et al. (1999) *J. Neurochem.* 73" 2047-2055) and $^{52}$Fe-labeled iron (III) hydroxide-sucrose complex (Beshara et al. (1999) *Br. J. Haematol.* 104: 288-295,296-302).

In some examples dual imaging in vitro and/or in vivo can be used to detect two or more detectable gene products, gene products that produce a detectable signal, gene products that can bind a detectable compound, or gene products that can bind other molecules to form a detectable product. In some examples, the two or more gene products are expressed by different viruses, whereas in other examples the two or more gene products are produced by the same virus. For example, a virus can express a gene product that emits a detectable signal and also express a gene product that catalyzes a detectable reaction. In other examples, a virus can express one or more gene products that emit a detectable signal, one or more gene products that catalyze a detectable reaction, one or more gene products that can bind a detectable compound or that can form a detectable product, or any combination thereof. Any combination of such gene products can be expressed by the viruses provided herein and can be used in combination with any of the methods provided herein. Imaging of such gene products can be performed, for example, by various imaging methods as described herein and known in the art (e.g., fluorescence imaging, MRI, PET, among many other methods of detection). Imaging of gene products can also be performed using the same method, whereby gene products are distinguished by their properties, such as by differences in wavelengths of light emitted. For example, a virus can express more than one fluorescent protein that differs in the wavelength of light emitted (e.g., a GFP and an RFP). In another non-limiting example, an RFP can be expressed with a luciferase. In yet other non-limiting examples, a fluorescent gene product can be expressed with a gene product, such as a ferritin or a transferrin receptor, used for magnetic resonance imaging. A virus expressing two or more detectable gene products or two or more viruses expressing two or more detectable gene products can be imaged in vitro or in vivo using such methods. In some embodiments the two or more gene products are expressed as a single polypeptide, such as a fusion protein. For example a fluorescent protein can be expressed as a fusion protein with a luciferase protein.

b. Therapeutic Gene Product

Viruses provided herein can be modified to express one or more genes whose products cause cell death or whose products cause an anti-tumor immune response; such genes can be considered therapeutic genes. A variety of therapeutic gene products, such as toxic or apoptotic proteins, or siRNA, are known in the art, and can be used with the viruses provided herein. The therapeutic genes can act by directly killing the host cell, for example, as a channel-forming or other lytic protein, or by triggering apoptosis, or by inhibiting essential cellular processes, or by triggering an immune response against the cell, or by interacting with a compound that has a similar effect, for example, by converting a less active compound to a cytotoxic compound. A large number of therapeutic proteins that can be expressed for tumor treatment are known in the art, including, but not limited to, a transporter, a cell-surface receptor, a cytokine, a chemokine, an apoptotic protein, a mitosis inhibitor protein, an antimitotic oligopeptide, an antiangiogenic factor (e.g., hk5), anti-cancer antibodies, such as a single-chain antibody (e.g., anti-VEGF), a toxin, a tumor antigen, a prodrug converting enzyme, a ribozyme, RNAi, and siRNA. Costimulatory molecules for the methods provided herein include any molecules which are capable of enhancing immune responses to an antigen/pathogen in vivo and/or in vitro. Costimulatory molecules also encompass any molecules which promote the activation, proliferation, differentiation, maturation or maintenance of lymphocytes and/or other cells whose function is important or essential for immune responses. An exemplary, non-limiting list of therapeutic proteins includes IL-24, WT1, p53, *pseudomonas* A endotoxin, *diphtheria* toxin, Arf, Bax, HSV TK, *E. coli* purine nucleoside phosphorylase, angiostatin and endostatin, p16, Rb, BRCA1, cystic fibrosis transmembrane regulator (CFTR), Factor VIII, low density lipoprotein receptor, beta-galactosidase, alpha-galactosidase, beta-glucocerebrosidase, insulin, parathyroid hormone, alpha-1-antitrypsin, rsCD40L, Fas-ligand, TRAIL, TNF, antibodies, microcin E492, *diphtheria* toxin, *Pseudomonas* exotoxin, *Escherichia coli* Shiga toxin, *Escherichia coli* Verotoxin 1, and hyperforin. Exemplary cytokines include, but are not limited to, chemokines and classical cytokines, such as the interleukins, including for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factor (GM-CSF) and exemplary chemokines including, but not limited to CXC chemokines such as IL-8 GROα, GROβ, GROγ, ENA-78, LDGF-PBP, GCP-2, PF4, Mig, IP-10, SDF-1α/β, BUNZO/STRC33, I-TAC, BLC/BCA-1; CC chemokines such as MIP-1α, MIP-1β, MDC, TECK, TARC, RANTES, HCC-1, HCC-4, DC-CK1, MIP-3α, MCP-1β, MCP-2, MCP-3, MCP-4, Eotaxin, Eotaxin-2/MPIF-2, I-309, MIP-5/HCC-2, MPIF-1, 6Ckine, CTACK, MEC; lymphotactin; and fractalkine. Exemplary other costimulatory molecules include immunoglobulin superfamily of cytokines, such as B7.1, B7.2. Other therapeutic proteins that can be expressed by the viruses include but are not limited to an anti-VEGF single chain antibody (e.g., SEQ ID NO: 106), a plasminogen K5 domain (e.g., SEQ ID NO: 109), a human tissue factor-αvβ3-integrin RGD fusion protein (e.g., SEQ ID NO: 105), interleukin-24 (e.g., SEQ ID NO: 107) or an IL-6-IL-6 receptor fusion protein (e.g., SEQ ID NO: 108). Exemplary viruses are provided herein that encode a transporter protein, such as hNET, and a therapeutic protein, IL-24 (see description of GLV-1h146 and GLV-1h150 provided in the Examples below).

In other embodiments, the viruses can express a protein that converts a less active compound into a compound that causes tumor cell death. Exemplary methods of conversion of such a prodrug compound include enzymatic conversion and photolytic conversion. A large variety of protein/compound pairs are known in the art, and include, but are not limited to, Herpes simplex virus thymidine kinase/ganciclovir, Herpes simplex virus thymidine kinase/(E)-5-(2-bromovinyl)-2'-deoxyuridine (BVDU), varicella zoster thymidine kinase/ganciclovir, varicella zoster thymidine kinase/BVDU, varicella zoster thymidine kinase/(E)-5-(2-bromovinyl)-1-beta-D-arabinofuranosyluracil (BVaraU), cytosine deaminase/5-fluorouracil, cytosine deaminase/5-fluorocytosine, purine nucleoside phosphorylase/6-methylpurine deoxyriboside, beta lactamase/cephalosporin-doxorubicin, carboxypeptidase G2/4-[(2-chloroethyl)(2-mesuloxyethyl)amino]benzoyl-L-glutamic acid (CMDA), carboxypeptidase A/methotrexate-phenylamine, cytochrome P450/acetominophen, cytochrome P450-2B1/cyclophosphamide, cytochrome P450-B1/2-aminoanthracene, 4-ipomeanol, horseradish peroxidase/indole-3-acetic acid, nitroreductase/CB1954, rabbit carboxylesterase/7-ethyl-10-[4-(1-piperidino)-1-piperidino] carbonyloxy-camptothecin (CPT-11), mushroom tyrosinase/bis-(2-chloroethyl)amino-4-hydroxyphenylaminomethanone 28, beta galactosidase/1-chloromethyl-5-hydroxy-1,2-dihyro-3H-benz[e]indole, beta glucuronidase/epirubicin glucuronide, thymidine phosphorylase/5'-deoxy5-fluorouridine, deoxycytidine kinase/cytosine arabinoside, and linamerase/linamarin.

In another embodiment, the therapeutic gene product can be an siRNA molecule. The siRNA molecule can be directed against expression of a tumor-promoting gene, such as, but not limited to, an oncogene, growth factor, angiogenesis promoting gene, or a receptor. The siRNA molecule also can be directed against expression of any gene essential for cell growth, cell replication or cell survival. The siRNA molecule also can be directed against expression of any gene that stabilizes the cell membrane or otherwise limits the number of tumor cell antigens released from the tumor cell. Design of an siRNA can be readily determined according to the selected target of the siRNA; methods of siRNA design and down-regulation of genes are known in the art, as exemplified in U.S. Pat. Pub. No. 2003-0198627.

In another embodiment, the therapeutic gene product can be a viral attenuation factor. Antiviral proteins or peptides can be expressed by the viruses provided herein. Expression of antiviral proteins or peptides can control viral pathogenicity. Exemplary viral attenuation factors include, but are not limited to, virus-specific antibodies, mucins, thrombospondin, and soluble proteins such as cytokines, including, but not limited to TNFα, interferons (for example IFNα, IFNβ, or IFNγ) and interleukins (for example IL-1, IL-12 or IL-18).

In another embodiment, the therapeutic gene product can be a protein ligand, such as antitumor oligopeptide. Antitumor oligopeptides are short protein peptides with high affinity and specificity to tumors. Such oligopeptides could be enriched and identified using tumor-associated phage libraries (Akita et al. (2006) *Cancer Sci.* 97(10):1075-1081). These oligopeptides have been shown to enhance chemotherapy (U.S. Pat. No. 4,912,199). The oligopeptides can be expressed by the viruses provided herein. Expression of the oligopeptides can elicit anticancer activities on their own or in combination with other chemotherapeutic agents. An exemplary group of antitumor oligopeptides is antimitotic peptides, including, but not limited to, tubulysin (Khalil et al. (2006) *Chembiochem.* 7(4):678-683), phomopsin, hemiasterlin, taltobulin (HTI-286, 3), and cryptophycin. Tubulysin is from myxobacteria and can induce depletion of cell microtubules and trigger the apoptotic process. The antimitotic peptides can be expressed by the viruses provide herein and elicit anticancer activities on their own or in combination with other therapeutic modalities.

In another embodiment, the therapeutic gene product can be a protein that sequesters molecules or nutrients needed for tumor growth. For example, the virus can express one or more proteins that bind iron, transport iron, or store iron, or a combination thereof. Increased iron uptake and/or storage by expression of such proteins not only, increases contrast for visualization and detection of a tumor or tissue in which the virus accumulates, but also depletes iron from the tumor environment. Iron depletion from the tumor environment removes a vital nutrient from the tumors, thereby deregulating iron hemostasis in tumor cells and delaying tumor progression and/or killing the tumor.

Additionally, iron, or other labeled metals, can be administered to a tumor-bearing subject, either alone, or in a conjugated form. An iron conjugate can include, for example, iron conjugated to an imaging moiety or a therapeutic agent. In some cases, the imaging moiety and therapeutic agent are the same, e.g., a radionuclide. Internalization of iron in the tumor, wound, area of inflammation or infection allows the internalization of iron alone, a supplemental imaging moiety, or a therapeutic agent (which can deliver cytotoxicity specifically to tumor cells or deliver the therapeutic agent for treatment of the wound, area of inflammation or infection). These methods can be combined with any of the other methods provided herein.

c. Superantigen

The viruses provided herein can be modified to express one or more superantigens. Superantigens are antigens that can activate a large immune response, often brought about by a large response of T cells. A variety of superantigens are known in the art including, but not limited to, *diphtheria* toxin, staphylococcal enterotoxins (SEA, SEB, SEC1, SEC2, SED, SEE and SEH), Toxic Shock Syndrome Toxin 1, Exfoliating Toxins (EXft), Streptococcal Pyrogenic Exotoxin A, B and C (SPE A, B and C), Mouse Mammary Tumor Virus proteins (MMTV), Streptococcal M proteins, Clostridial Perfringens Enterotoxin (CPET), *Listeria monocytogenes* antigen p60, and mycoplasma arthritis superantigens.

Since many superantigens also are toxins, if expression of a virus of reduced toxicity is desired, the superantigen can be modified to retain at least some of its superantigenicity while reducing its toxicity, resulting in a compound such as a toxoid. A variety of recombinant superantigens and toxoids of superantigens are known in the art, and can readily be expressed in the viruses provided herein. Exemplary toxoids include toxoids of *diphtheria* toxin, as exemplified in U.S. Pat. No. 6,455,673 and toxoids of Staphylococcal enterotoxins, as exemplified in U.S. Pat. Pub. No. 20030009015.

d. Gene Product to be Harvested

Exemplary genes expressible by a virus provided herein for the purpose of harvesting include human genes. An exemplary list of genes includes the list of human genes and genetic disorders authored and edited by Dr. Victor A. McKusick and his colleagues at Johns Hopkins University and elsewhere, and developed for the World Wide Web by NCBI, the National Center for Biotechnology Information. Online Mendelian Inheritance in Man, OMIM™, Center for Medical Genetics, Johns Hopkins University (Baltimore, Md.) and National Center for Biotechnology Information, National Library of Medicine (Bethesda, Md.), and those available in public databases, such as PubMed and GenBank (see, for example, genes provided in the website ncbi.nlm.nih.gov/entrez/query.fcgi?db=OMIM).

e. Control of Heterologous Gene Expression

In one embodiment, expression the therapeutic compound can be controlled by a regulatory sequence. Suitable regulatory sequences which, for example, are functional in a mammalian host cell are well known in the art. In one example, the regulatory sequence contains a poxvirus promoter. In another embodiment, the regulatory sequence can contain a natural or synthetic vaccinia virus promoter. Strong late promoters can be used to achieve high levels of expression of the foreign genes. Early and intermediate-stage promoters can also be used. In one embodiment, the promoters contain early and late promoter elements, for example, the vaccinia virus early/late promoter P7.5k, vaccinia late promoter P11k, a synthetic early/late vaccinia PSEL promoter (Patel et al., (1988) *Proc. Natl. Acad. Sci. USA* 85: 9431-9435; Davison and Moss, (1989) *J Mol Biol* 210: 749-769; Davison et al. (1990) *Nucleic Acids Res.* 18: 4285-4286; Chakrabarti et al. (1997), *BioTechniques* 23: 1094-1097). As described in the Examples and elsewhere herein, the viruses provided can exhibit differences in characteristics, such as attenuation, as a result of using a stronger promoter versus a weaker promoter. For example, in vaccinia, synthetic early/late and late promoters are relatively strong promoters, whereas vaccinia synthetic early, P7.5k early/late, P7.5k early, and P28 late promoters are relatively weaker promoters (see e.g., Chakrabarti et al. (1997) *BioTechniques* 23(6) 1094-1097). Combinations of different promoters can be used to express different gene products in the same virus or two different viruses. In one embodiment, different therapeutic or detectable gene products are expressed from different promoters, such as two different vaccinia synthetic promoters.

F. Methods for Making a Modified Virus

The viruses provided herein can be formed by standard methodologies well known in the art for modifying viruses. Briefly, the methods include introducing into viruses one or more genetic modifications, followed by screening the viruses for properties reflective of the modification or for other desired properties.

1. Genetic Modifications

Standard techniques in molecular biology can be used to generate the modified viruses provided herein. Such techniques include various nucleic acid manipulation techniques, nucleic acid transfer protocols, nucleic acid amplification protocols, and other molecular biology techniques known in the art. For example, point mutations can be introduced into a gene of interest through the use of oligonucleotide mediated site-directed mutagenesis. Alternatively, homologous recombination can be used to introduce a mutation or exogenous sequence into a target sequence of interest. In an alternative mutagenesis protocol, point mutations in a particular gene can also be selected for using a positive selection pressure. See, e.g., Current Techniques in Molecular Biology, (Ed. Ausubel, et al.). Nucleic acid amplification protocols include but are not limited to the polymerase chain reaction (PCR). Use of nucleic acid tools such as plasmids, vectors, promoters and other regulating sequences, are well known in the art for a large variety of viruses and cellular organisms. Nucleic acid transfer protocols include calcium chloride transformation/transfection, electroporation, liposome mediated nucleic acid transfer, N-[1-(2,3-Dioloyloxy)propyl]-N,N,N-trimethylammonium methylsulfate meditated transformation, and others. Further a large variety of nucleic acid tools are available from many different sources including ATCC, and various commercial sources. One skilled in the art will be readily able to select the appropriate tools and methods for genetic modifications of any particular virus according to the knowledge in the art and design choice.

Any of a variety of modifications can be readily accomplished using standard molecular biological methods known in the art. The modifications will typically be one or more truncations, deletions, mutations or insertions of the viral genome. In one embodiment, the modification can be specifically directed to a particular sequence. The modifications can be directed to any of a variety of regions of the viral genome, including, but not limited to, a regulatory sequence, to a gene-encoding sequence, or to a sequence without a known role. Any of a variety of regions of viral genomes that are available for modification are readily known in the art for many viruses, including the viruses specifically listed herein. As a non-limiting example, the loci of a variety of vaccinia genes provided herein and elsewhere exemplify the number of different regions that can be targeted for modification in the viruses provided herein. In another embodiment, the modification can be fully or partially random, whereupon selection of any particular modified virus can be determined according to the desired properties of the modified the virus. These methods include, for example, in vitro recombination techniques, synthetic methods and in vivo recombination methods as described, for example, in Sambrook et al., *Molecular Cloning: A Laboratory Manual,* 2nd edition, Cold Spring Harbor Laboratory Press, cold Spring Harbor N.Y. (1989), and in the Examples disclosed herein.

In some embodiments, the virus can be modified to express an exogenous gene. Exemplary exogenous gene products include proteins and RNA molecules. The modified viruses can express a detectable gene product, a therapeutic gene product, a gene product for manufacturing or harvesting, or an antigenic gene product for antibody harvesting. The characteristics of such gene products are described herein and elsewhere. In some embodiments of modifying an organism to express an exogenous gene, the modification can also contain one or more regulatory sequences to regulate expression of the exogenous gene. As is known in the art, regulatory sequences can permit constitutive expression of the exogenous gene or can permit inducible expression of the exogenous gene. Further, the regulatory sequence can permit control of the level of expression of the exogenous gene. In some examples, inducible expression can be under the control of cellular or other factors present in a tumor cell or present in a virus-infected tumor cell. In other examples, inducible expression can be under the control of an administrable substance, including IPTG, RU486 or other known induction compounds. Any of a variety of regulatory sequences are available to one skilled in the art according to known factors and design preferences. In some embodiments, such as gene product manufacture and harvesting, the regulatory sequence can result in constitutive, high levels of gene expression. In some embodiments, such as anti-(gene product) antibody harvesting, the regulatory sequence can result in constitutive, lower levels of gene expression. In tumor therapy embodiments, a therapeutic protein can be under the control of an internally inducible promoter or an externally inducible promoter.

In other embodiments, organ or tissue-specific expression can be controlled by regulatory sequences. In order to achieve expression only in the target organ, for example, a tumor to be treated, the foreign nucleotide sequence can be linked to a tissue specific promoter and used for gene therapy. Such promoters are well known to those skilled in the art (see e.g., Zimmermann et al., *Neuron* 12: 11-24 (1994); Vidal et al., *EMBO J.* 9: 833-840 (1990); Mayford et al., *Cell* 81: 891-904 (1995); and Pinkert et al., *Genes & Dev.* 1: 268-76 (1987)).

In some embodiments, the viruses can be modified to express two or more proteins, where any combination of the two or more proteins can be one or more detectable gene products, therapeutic gene products, gene products for manufacturing or harvesting or antigenic gene products for antibody harvesting. In one embodiment, a virus can be modified to express a detectable protein and a therapeutic protein. In another embodiment, a virus can be modified to express two or more gene products for detection or two or more therapeutic gene products. For example, one or more proteins involved in biosynthesis of a luciferase substrate can be expressed along with luciferase. When two or more exogenous genes are introduced, the genes can be regulated under the same or different regulatory sequences, and the genes can be inserted in the same or different regions of the viral genome, in a single or a plurality of genetic manipulation steps. In some embodiments, one gene, such as a gene encoding a detectable gene product, can be under the control of a constitutive promoter, while a second gene, such as a gene encoding a therapeutic gene product, can be under the control of an inducible promoter. Methods for inserting two or more genes in to a virus are known in the art and can be readily performed for a wide variety of viruses using a wide variety of exogenous genes, regulatory sequences, and/or other nucleic acid sequences.

Methods of producing recombinant viruses are known in the art. Provided herein for exemplary purposes are methods of producing a recombinant vaccinia virus. A recombinant vaccinia virus with an insertion in the F14.5L gene (NotI site of LIVP) can be prepared by the following steps: (a) generating (i) a vaccinia shuttle plasmid containing the modified F14.5L gene inserted at restriction site X and (ii) a dephosphorylated wt VV (VGL) DNA digested at restriction site X; (b) transfecting host cells infected with PUV-inactivated helper VV (VGL) with a mixture of the constructs of (i) and (ii) of step a; and (c) isolating the recombinant vaccinia viruses from the transfectants. One skilled in the art knows how to perform such methods, for example by following the instructions given in co-pending U.S. application Ser. Nos. 10/872,156 and 11/238,025; see also Timiryasova et al. (*Biotechniques* 31: 534-540 (2001)). In one embodiment, restriction site X is a unique restriction site. A variety of suitable host cells also are known to the person skilled in the art and include many mammalian, avian and insect cells and tissues which are susceptible for vaccinia virus infection, including chicken embryo, rabbit, hamster and monkey kidney cells, for example, HeLa cells, $RK_{13}$, CV-1, Vero, BSC40 and BSC-1 monkey kidney cells.

2. Screening of Modified Viruses

Modified viruses can be screened for any desired characteristics, including the characteristics described herein such as attenuated pathogenicity, reduced toxicity, preferential accumulation in tumor, increased ability to activate an immune response against tumor cells, increased immunogenicity, increased or decreased replication competence, and are able to express exogenous proteins, and combinations thereof. For example, the modified viruses can be screened for the ability to activate an immune response against tumor cells without aggressively killing the tumor cells. In another example, the viruses can be screened for expression of one or more detectable genes, including genes that can be used for imaging, or for expression of one or more genes for manufacture or harvest of the gene products and/or for harvest of antibodies against the gene products.

Any of a variety of known methods for screening for such characteristics can be performed, as demonstrated in the Examples provided herein. One exemplary method for screening for desired characteristics includes, but is not limited to, monitoring growth, replication and/or gene expression (including expression of an exogenous gene) in cell culture or other in vitro medium. The cell culture can be from any organism, and from any tissue source, and can include tumorous tissues. Other exemplary methods for screening for desired characteristics include, but are not limited to, administering a virus to animal, including non-human animals such as a mouse, monkey or ape, and optionally also including humans, and monitoring the virus, the tumor, and or the animal; monitoring can be performed by in vivo imaging of the virus and/or the tumor (e.g., low light imaging of viral gene expression or ultrasonic tumor imaging), external monitoring of the tumor (e.g., external measurement of tumor size), monitoring the animal (e.g., monitoring animal weight, blood panel, antibody titer, spleen size, or liver size). Other exemplary methods for screening for desired characteristics include, but are not limited to, harvesting a non-human animal for the effects and location of the virus and expression by the virus, including methods such as harvesting a variety of organs including a tumor to determine presence of the virus and/or gene expression by the virus in the organs or tumor, harvesting of organs associated with an immune response or viral clearance such as the spleen or liver, harvesting the tumor to determine tumor size and viability of tumor cells, harvesting antibodies or antibody producing cells. Such screening and monitoring methods can be used in any of a variety of combinations, as is known in art. In one embodiment, a virus can be screened by administering the virus to an animal such as a non-human animal or a human, followed by monitoring by in vivo imaging. In another embodiment, a virus can be screened by administering the virus to an animal such as a non-human animal, monitoring by in vivo imaging, and then harvesting the animal. Thus, provided herein are methods for screening a virus for desired characteristics by administering the virus to an animal such as an animal with a tumor, and monitoring the animal, tumor (if present), and/or virus in the animal for one or more characteristics. Also provided herein are methods for screening a virus for desired characteristics by administering the virus to a non-human animal such as a non-human animal with a tumor, harvesting the animal, and assaying the animal's organs, antibody titer, and/or tumor (if present) for one or more characteristics.

Provided herein are methods for screening a virus for attenuated pathogenicity or reduced toxicity, where the pathogenicity or toxicity can be determined by a variety of techniques, including, but not limited to, assessing the health state of the subject, measuring the body weight of a subject, blood or urine analysis of a subject, and monitoring tissue distribution of the virus within the subject; such techniques can be performed on a living subject in vivo, or can be performed post mortem. Methods also can include the ability of the viruses to lyse cells or cause cell death, which can be determined in vivo or in vitro.

When a subject drops below a threshold body weight, the virus can be considered pathogenic to the subject. Exemplary thresholds can be a drop of about 5% or more, a drop of about 10% or more, or a drop of about 15% or more in body weight relative to a reference. A body weight reference can be selected from any of a variety of references used in the art; for example, a body weight reference can be the weight of the subject prior to administration of the virus, the body weight reference can be a control subject having the same condition as the test subject (e.g., normal or tumor-injected), where the change in weight of the control is compared to the change in weight of the test subject for the time period after administration of the virus.

Blood or urine analysis of the subject can indicate level of immune response, level of toxins in the subject, or other levels of stress to cells, tissues or organs of the subject such as kidneys, pancreas, liver and spleen. Levels increased above established threshold levels can indicate pathogenicity of the virus to the subject. Threshold levels of components of blood or urine for indicating viral pathogenicity are well known in the art, and any such thresholds can be selected herein according to the desired tolerance of pathogenicity or toxicity of the virus.

Tissue distribution of a virus in a subject can indicate pathogenicity or toxicity of the virus. In one embodiment, tissue distribution of a virus that is not pathogenic or toxic can be mostly in tumor relative to other tissues or organs. Microorganisms located mostly in tumor can accumulate, for example, at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the viruses accumulate in any other particular organ or tissue.

Provided herein are methods for screening a virus for tissue distribution or accumulation, where the tissue distribution can be determined by a variety of techniques, including, but not limited to, harvesting a non-human subject, in vivo imaging a detectable gene product in subject. Harvesting can be accomplished by euthanizing the non-human subject, and determining the accumulation of viruses in tumor and, optionally, the accumulation in one or more additional tissues or organs. The accumulation can be determined by any of a variety of methods, including, but not limited to, detecting gene products such as detectable gene products (e.g., GFP or beta galactosidase), histological or microscopic evaluation of tissue, organ or tumor samples, or measuring the number of plaque or colony forming units present in a tissue, organ or tumor sample. In one embodiment, the desired amount of tissue distribution of a virus can be mostly in tumor relative to other tissues or organs. Microorganisms located mostly in tumor can accumulate, for example, at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the viruses accumulate in any other particular organ or tissue.

Also provided herein are methods of screening for viruses that can elicit an immune response, where the immune response can be against the tumor cells or against the viruses. A variety of methods for measuring the ability to elicit an immune response are known in the art, and include measuring an overall increase in immune activity in a subject, measuring an increase in anti-virus or anti-tumor antibodies in a subject, testing the ability of a virus-treated (typically a non-human) subject to prevent later infection/tumor formation or to rapidly eliminate viruses or tumor cells. Methods also can include the ability of the viruses to lyse cells or cause cell death, which can be determined in vivo or in vitro.

Also provided herein are methods for determining increased or decreased replication competence, by monitoring the speed of replication of the viruses. Such measurements can be performed in vivo or in vitro. For example, the speed of replication in a cell culture can be used to determine replication competence of a virus. In another example, the speed of replication in a tissue, organ or tumor in a subject can be used to measure replication competence. In some embodiments, decreased replication competence in non-tumor tissues and organs can be the characteristic to be selected in a screen. In other embodiments, increased replication competence in tumors can be the characteristic to be selected in a screen.

Also provided herein are methods for determining the ability of a virus to express genes, such as exogenous gene. Such methods can be performed in vivo or in vitro. For example, the viruses can be screened on selective plates for the ability to express a gene that permits survival of the virus or permits the virus to provide a detectable signal, such as turning X-gal blue. Such methods also can be performed in vivo, where expression can be determined, for example, by harvesting tissues, organs or tumors a non-human subject or by in vivo imaging of a subject.

Also provided herein are methods for determining the ability of a virus to express genes toward which the subject can develop antibodies, including exogenous genes toward which the subject can develop antibodies. Such methods can be performed in vivo using any of a variety of non-human subjects. For example, gene expression can be determined, for example, by bleeding a non-human subject to which a virus has been administered, and assaying the blood (or serum) for the presence of antibodies against the virus-expressed gene, or by any other method generally used for polyclonal antibody harvesting, such as production bleeds and terminal bleeds.

Also provided herein are methods for screening a virus that has two or more characteristics provided herein, including screening for attenuated pathogenicity, reduced toxicity, preferential accumulation in tumor, increased ability to activate an immune response against tumor cells, increased immunogenicity, increased or decreased replication competence, ability to express exogenous proteins, and ability to elicit antibody production against a virally expressed gene product. A single monitoring technique, such as in vivo imaging, can be used to verify two or more characteristics, or a variety of different monitoring techniques can be used, as can be determined by one skilled in the art according to the selected characteristics and according to the monitoring techniques used.

Mouse models of different types of human and non-human animal cancers can be employed to assess the properties of the modified viruses. Tumors can be established by implantation of different tumor cell types. Exemplary human tumor xenograft models in mice include, but are not limited to, human lung carcinoma (A549 cells, ATCC No. CCL-185); human breast tumor (GI-101A cells, Rathinavelu et al., *Cancer Biochem. Biophys.*, 17:133-146 (1999)); human ovarian carcinoma (OVCAR-3 cells, ATCC No. HTB-161); human pancreatic carcinoma (PANC-1 cells, ATCC No. CRL-1469 and MIA PaCa-2 cells, ATCC No. CRL-1420); DU145 cells (human prostate cancer cells, ATCC No. HTB-81); human prostate cancer (PC-3 cells, ATCC# CRL-1435); colon carcinoma (HT-29 cells); human melanoma (888-MEL cells, 1858-MEL cells or 1936-MEL cells; see e.g. Wang et al., (2006) *J. Invest. Dermatol.* 126:1372-1377); and human fibrosarcoma (HT-1080 cells, ATCC No. CCL-121,). Exemplary rat tumor xenograft models in mice include, but are not limited to, glioma tumor (C6 cells; ATCC No. CCL-107). Exemplary mouse tumor homograft models include, but are not limited to, mouse melanoma (B16-F10 cells; ATCC No. CRL-6475). Exemplary cat tumor xenograft models in mice include, but are not limited to, feline fibrosarcoma (FC77.T cells; ATCC No. CRL-6105). Exemplary dog tumor xenograft models in mice include, but are not limited to, canine osteosarcoma (D17 cells; ATCC No. CCL-183).

G. Exemplary Characteristics of the Viruses Provided

The viruses provided herein can accumulate in immunoprivileged cells or immunoprivileged tissues, including tumors and/or metastases, and also including wounded tissues and cells. While the viruses provided herein can typically be cleared from the subject to whom the viruses are administered by activity of the subject's immune system, viruses can nevertheless accumulate, survive and proliferate in immunoprivileged cells and tissues such as tumors because such immunoprivileged areas are sequestered from the host's immune system. Accordingly, the methods provided herein, as applied to tumors and/or metastases, and therapeutic methods relating thereto, can readily be applied to other immunoprivileged cells and tissues, including wounded cells and tissues.

1. Attenuated

The viruses provided herein and viruses provided for use in the methods are typically attenuated. Attenuated viruses have a decreased capacity to cause disease in a host. The decreased capacity can result from any of a variety of different modifications to the ability of a virus to be pathogenic. For example, a virus can have reduced toxicity, reduced ability to accumulate in non-tumorous organs or tissue, reduced ability to cause cell lysis or cell death, or reduced ability to replicate compared to the non-attenuated form thereof. The attenuated viruses provided herein, however, retain at least some capacity to replicate and to cause immunoprivileged cells and tissues, such as tumor cells to leak or lyse, undergo cell death, or otherwise cause or enhance an immune response to immunoprivileged cells and tissues, such as tumor cells.

a. Reduced Toxicity

Viruses can be toxic to their hosts by manufacturing one or more compounds that worsen the health condition of the host. Toxicity to the host can be manifested in any of a variety of manners, including septic shock, neurological effects or muscular effects. The viruses provided herein can have a reduced toxicity to the host. The reduced toxicity of a virus of the present methods and compositions can range from a toxicity in which the host experiences no toxic effects, to a toxicity in which the host does not typically die from the toxic effects of the microbes. In some embodiments, the viruses are of a reduced toxicity such that a host typically has no significant long-term effect from the presence of the viruses in the host, beyond any effect on tumorous, metastatic or necrotic organs or tissues. For example, the reduced toxicity can be a minor fever or minor infection, which lasts for less than about a month, and following the fever or infection, the host experiences no adverse effects resultant from the fever or infection. In another example, the reduced toxicity can be measured as an unintentional decline in body weight of about 5% or less for the host after administration of the microbes. In other examples, the virus has no toxicity to the host.

b. Accumulate in Tumor, Not Substantially in Other Organs

Viruses can accumulate in any of a variety of tissues and organs of the host. Accumulation can be evenly distributed over the entire host organism, or can be concentrated in one or a few organs or tissues. The viruses provided herein can accumulate in targeted tissues, such as immunoprivileged cells and tissues, such as tumors and also metastases. In some embodiments, the viruses provided herein exhibit accumulation in immunoprivileged cells and tissues, such as tumor cells relative to normal organs or tissues that is equal to or greater than the accumulation that occurs with wild-type viruses. In other embodiments, the viruses provided herein exhibit accumulation in immunoprivileged cells and tissues, such as tumor cells that is equal to or greater than the accumulation in any other particular organ or tissue. For example, the viruses provided herein can demonstrate an accumulation in immunoprivileged cells and tissues, such as tumor cells that is at least about 2-fold greater, at least about 5-fold greater, at least about 10-fold greater, at least about 100-fold greater, at least about 1,000-fold greater, at least about 10,000-fold greater, at least about 100,000-fold greater, or at least about 1,000,000-fold greater, than the accumulation in any other particular organ or tissue.

In some embodiments, a virus can accumulate in targeted tissues and cells, such as immunoprivileged cells and tissues, such as tumor cells, without accumulating in one or more selected tissues or organs. For example, a virus can accumulate in tumor cells without accumulating in the brain. In another example, a virus can accumulate in tumor cells without accumulating in neural cells. In another example, a virus can accumulate in tumor cells without accumulating in ovaries. In another example, a virus can accumulate in tumor cells without accumulating in the blood. In another example, a virus can accumulate in tumor cells without accumulating in the heart. In another example, a virus can accumulate in tumor cells without accumulating in the bladder. In another example, a virus can accumulate in tumor cells without accumulating in testes. In another example, a virus can accumulate in tumor cells without accumulating in the spleen. In another example, a virus can accumulate in tumor cells without accumulating in the lungs.

One skilled in the art can determine the desired capability for the viruses to selectively accumulate in targeted tissue or cells, such as in an immunoprivileged cells and tissues, such as tumor rather than non-target organs or tissues, according to a variety of factors known in the art, including, but not limited to, toxicity of the viruses, dosage, tumor to be treated, immunocompetence of host, and disease state of the host.

c. Ability to Elicit or Enhance Immune Response to Tumor Cells

Viruses herein can cause or enhance an immune response to antigens in the targeted tissues or cells, such as immunoprivileged cells and tissues, such as tumor cells. The immune response can be triggered by any of a variety of mechanisms, including the presence or expression of immunostimulatory cytokines and the expression or release antigenic compounds that can cause an immune response.

Cells, in response to an infection such as a viral infection, can send out signals to stimulate an immune response against the cells. Exemplary signals sent from such cells include antigens, cytokines and chemokines such as interferon-gamma and interleukin-15. The viruses provided herein can cause targeted cells to send out such signals in response to infection by the microbes, resulting in a stimulation of the host's immune system against the targeted cells or tissues, such as tumor cells.

In another embodiment, targeted cells or tissues, such as tumor cells, can contain one or more compounds that can be recognized by the host's immune system in mounting an immune response against a tumor. Such antigenic compounds can be compounds on the cell surface or the tumor cell, and can be protein, carbohydrate, lipid, nucleic acid or combinations thereof. Viral-mediated release of antigenic compounds can result in triggering the host's immune system to mount an immune response against the tumor. The amount of antigenic compound released by the tumor cells is any amount sufficient to trigger an immune response in a subject; for example, the antigenic compounds released from one or more tumor cells can trigger a host immune response in the organism that is known to be accessible to leukocytes.

The time duration of antigen release is an amount of time sufficient for the host to establish an immune response to one or more tumor antigens. In some embodiments, the duration is an amount of time sufficient for the host to establish a sustained immune response to one or more tumor antigens. One skilled in the art can determine such a time duration based on a variety of factors affecting the time duration for a subject to develop an immune response, including the level of the tumor antigen in the subject, the number of different tumor antigens, the antigenicity of the antigen, the immunocompetence of the host, and the access of the antigenic material to the vasculature of the host. Typically, the duration of antigen release can be at least about a week, at least about 10 days, at least about two weeks, or at least about a month.

The viruses provided herein can have any of a variety of properties that can cause target cells and tissues, such as tumor cells, to release antigenic compounds. Exemplary properties are the ability to lyse cells and the ability to elicit apoptosis in tumor cells. Viruses that are unable to lyse tumor cells or cause tumor cell death can nevertheless be used in the methods provided herein when such viruses can cause some release or display of antigenic compounds from tumor cells. A variety of mechanisms for antigen release or display without lysis or cell death are known in the art, and any such mechanism can be used by the viruses provided herein, including, but not limited to, secretion of antigenic compounds, enhanced cell membrane permeability, expression of immunostimulatory proteins or altered cell surface expression or altered MHC presentation in tumor cells when the tumor cells can be accessed by the host's immune system. Regardless of the mechanism by which the host's immune system is activated, the net result of the presence of the viruses in the tumor is a stimulation of the host's immune system, at least in part, against the tumor cells. In one example, the viruses can cause an immune response against tumor cells not infected by the viruses.

In one embodiment, the viruses provided herein can cause tumor cells to release an antigen that is not present on the tumor cell surface. Tumor cells can produce compounds such as proteins that can cause an immune response; however, in circumstances in which the antigenic compound is not on the tumor cell surface, the tumor can proliferate, and even metastasize, without the antigenic compound causing an immune response. Within the scope of the present methods, the viruses provided herein can cause antigenic compounds within the cell to release away from the cell and away from the tumor, which can result in triggering an immune response to such an antigen. Even if not all cells of a tumor are releasing antigens, the immune response can initially be targeted toward the "leaky" tumor cells, and the bystander effect of the immune response can result in further tumor cell death around the "leaky" tumor cells.

d. Balance of Pathogenicity and Release of Tumor Antigens

Typical methods of involving treatment of targeted cells and tissues, such as immunoprivileged cells and tissues, such as tumors, are designed to cause rapid and complete removal thereof. For example, many viruses can cause lysis and/or apoptosis in a variety of cells, including tumor cells. Viruses that can vigorously lyse or cause cell death can be highly pathogenic, and can even kill the host. Furthermore, therapeutic methods based upon such rapid and complete lysis are typically therapeutically ineffective.

In contrast, the viruses provided herein are not aggressive in causing cell death or lysis. They can have a limited or no ability to cause cell death as long as they accumulate in the target cells or tissues and result in alteration of cell membranes to cause leakage of antigens against which an immune response is mounted. It is desirable that their apoptotic or lytic effect is sufficiently slow or ineffective to permit sufficient antigenic leakage for a sufficient time for the host to mount an effective immune response against the target tissues. Such immune response alone or in combination with the lytic/apoptotic effect of the virus results in elimination of the target tissue and also elimination of future development, such as metastases and reoccurrence, of such tissues or cells. While the viruses provided herein can have a limited ability to cause cell death, the viruses provided herein can nevertheless stimulate the host's immune system to attack tumor cells. As a result, such viruses also are typically unlikely to have substantial toxicity to the host.

In one embodiment, the viruses have a limited, or no ability to cause tumor cell death, while still causing or enhancing an immune response against tumor cells. In one example, the rate of viral-mediated tumor cell death is less than the rate of tumor cell growth or replication. In another example, the rate of viral-mediated tumor cell death is slow enough for the host to establish a sustained immune response to one or more tumor antigens. Typically, the time for cell death is sufficient to establish an anti-tumor immune response and can be at least about a week, at least about 10 days, at least about two weeks, or at least about a month, depending upon the host and the targeted cells or tissues.

In another embodiment, the viruses provided herein can cause cell death in tumor cells, without causing substantial cell death in non-tumor tissues. In such an embodiment, the viruses can aggressively kill tumor cells, as long as no substantial cell death occurs in non-tumor cells, and optionally, so long as the host has sufficient capability to mount an immune response against the tumor cells.

In one embodiment, the ability of the viruses to cause cell death is slower than the host's immune response against the viruses. The ability for the host to control infection by the viruses can be determined by the immune response (e.g., antibody titer) against viral antigens. Typically, after the host has mounted immune response against the viruses, the viruses can have reduced pathogenicity in the host. Thus, when the ability of the viruses to cause cell death is slower than the host's immune response against the microbes, viral-mediated cell death can occur without risk of serious disease or death to the host. In one example, the ability of the viruses to cause tumor cell death is slower than the host's immune response against the microbes.

2. Immunogenicity

The viruses provided herein also can be immunogenic. An immunogenic virus can create a host immune response against the virus. In one embodiment, the viruses can be sufficiently immunogenic to result in a large anti-viral antibody titer. The viruses provided herein can have the ability to elicit an immune response. The immune response can be activated in response to viral antigens or can be activated as a result of viral-infection induced cytokine or chemokine production. Immune response against the viruses can decrease the likelihood of pathogenicity toward the host organism.

Immune response against the viruses also can result in target tissue or cell, such as tumor cell, killing. In one embodiment, the immune response against viral infection can result in an immune response against tumor cells, including developing antibodies against tumor antigens. In one example, an immune response mounted against the virus can result in tumor cell killing by the "bystander effect," where uninfected tumor cells nearby infected tumor cells are killed at the same time as infected cells, or alternatively, where uninfected tumor cells nearby extracellular viruses are killed at the same time as the viruses. As a result of bystander effect tumor cell death, tumor cell antigens can be released from cells, and the host organism's immune system can mount an immune response against tumor cell antigens, resulting in an immune response against the tumor itself.

In one embodiment, the virus can be selected or modified to express one or more antigenic compounds, including superantigenic compounds. The antigenic compounds such as superantigens can be endogenous gene products or can be exogenous gene products. Superantigens, including toxoids, are known in the art and described elsewhere herein.

3. Replication Competent

The viruses provided herein can be replication competent. In a variety of viral systems, the administered virus is rendered replication incompetent to limit pathogenicity risk to the host. While replication incompetence can protect the host from the virus, it also limits the ability of the virus to infect and kill tumor cells, and typically results in only a short-lived effect. In contrast, the viruses provided herein can be attenuated but replication competent, resulting in low toxicity to the host and accumulation mainly or solely in tumors. Thus, the viruses provided herein can be replication competent without creating a pathogenicity risk to the host.

Attenuation of the viruses provided herein can include, but is not limited to, reducing the replication competence of the virus. For example, a virus can be modified to decrease or eliminate an activity related to replication, such as a transcriptional activator that regulates replication in the virus. In an example, a virus, can have the viral thymidine kinase (TK) gene modified, which decreases replication of the virus.

4. Genetic Variants

The viruses provided herein can be modified from their wild type form. Modifications can include any of a variety of changes, and typically include changes to the genome or nucleic acid molecules of the viruses. Exemplary nucleic acid molecular modifications include truncations, insertions, deletions and mutations. In an exemplary modification, a viral gene can be modified by truncation, insertion, deletion or mutation. In an exemplary insertion, an exogenous gene can be inserted into the genome of the virus.

Modifications of the viruses provided herein can result in a modification of viral characteristics, including those provided herein such as pathogenicity, toxicity, ability to preferentially accumulate in tumor, ability to lyse cells or cause cell death, ability to elicit an immune response against tumor cells, immunogenicity and replication competence. Variants can be obtained by general methods such as mutagenesis and passage in cell or tissue culture and selection of desired properties, as is known in the art, as exemplified for respiratory syncytial virus in Murphy et al., *Virus Res.* 1994, 32:13-26.

Variants also can be obtained by mutagenic methods in which nucleic acid residues of the virus are added, removed or modified relative to the wild type. Any of a variety of known mutagenic methods can be used, including recombination-based methods, restriction endonuclease-based methods, and PCR-based methods. Mutagenic methods can be directed against particular nucleotide sequences such as genes, or can be random, where selection methods based on desired characteristics can be used to select mutated viruses. Any of a variety of viral modifications can be made, according to the selected virus and the particular known modifications of the selected virus.

H. Pharmaceutical Compositions, Combinations and Kits

Provided herein are pharmaceutical compositions, combinations and kits containing a virus that encodes a transporter protein provided herein and one or more components. Pharmaceutical compositions can include a virus provided herein and a pharmaceutical carrier. Combinations can include two or more viruses, a virus and a detecable substrate that is transported into cells that express the transporter encoded by the virus, a virus and a detectable compound, a virus and a viral expression modulating compound, a virus and a therapeutic compound, or any combination thereof. Kits can include the pharmaceutical compositions and/or combinations provided herein, and one or more components, such as instructions for use, a device for detecting a virus in a subject, a device for administering a compound to a subject and a device for administering a compound to a subject.

1. Pharmaceutical Compositions

Provided herein are pharmaceutical compositions containing a virus provided herein and a suitable pharmaceutical carrier. Pharmaceutical compositions provided herein can be in various forms, e.g., in solid, liquid, powder, aqueous, or lyophilized form. Examples of suitable pharmaceutical carriers are known in the art and include but are not limited to water, buffers, saline solutions, phosphate buffered saline solutions, various types of wetting agents, sterile solutions, alcohols, gum arabic, vegetable oils, benzyl alcohols, gelatin, glycerin, carbohydrates such as lactose, sucrose, amylose or starch, magnesium stearate, talc, silicic acid, viscous paraffin, perfume oil, fatty acid monoglycerides and diglycerides, pentaerythritol fatty acid esters, hydroxy methylcellulose, powders, among others. Pharmaceutical compositions provided herein can contain other additives including, for example, antioxidants and preservatives, analgesic agents, binders, disintegrants, coloring, diluents, excipients, extenders, glidants, solubilizers, stabilizers, tonicity agents, vehicles, viscosity agents, flavoring agents, emulsions, such as oil/water emulsions, emulsifying and suspending agents, such as acacia, agar, alginic acid, sodium alginate, bentonite, carbomer, carrageenan, carboxymethylcellulose, cellulose, cholesterol, gelatin, hydroxyethyl cellulose, hydroxypropyl cellulose, hydroxypropyl methylcellulose, methylcellulose, octoxynol 9, oleyl alcohol, povidone, propylene glycol monostearate, sodium lauryl sulfate, sorbitan esters, stearyl alcohol, tragacanth, xanthan gum, and derivatives thereof, solvents, and miscellaneous ingredients such as crystalline cellulose, microcrystalline cellulose, citric acid, dextrin, dextrose, liquid glucose, lactic acid, lactose, magnesium chloride, potassium metaphosphate, starch, among others. Such carriers and/or additives can be formulated by conventional methods and can be administered to the subject at a suitable dose. Stabilizing agents such as lipids, nuclease inhibitors, polymers, and chelating agents can preserve the compositions from degradation within the body.

Colloidal dispersion systems that can be used for delivery of viruses include macromolecule complexes, nanocapsules, microspheres, beads and lipid-based systems including oil-in-water emulsions (mixed), micelles, liposomes and lipoplexes. An exemplary colloidal system is a liposome. Organ-specific or cell-specific liposomes can be used in order to achieve delivery only to the desired tissue. The targeting of liposomes can be carried out by the person skilled in the art by applying commonly known methods. This targeting includes passive targeting (utilizing the natural tendency of the liposomes to distribute to cells of the RES in organs which contain sinusoidal capillaries) or active targeting (for example, by coupling the liposome to a specific ligand, for example, an antibody, a receptor, sugar, glycolipid and protein by methods know to those of skill in the art). In the present methods, monoclonal antibodies can be used to target liposomes to specific tissues, for example, tumor tissue, via specific cell-surface ligands.

2. Host cells

Also provided herein are host cells that contain a virus provided herein, such as a modified vaccinia virus. Such cells can be group of a single type of cells or a mixture of different types of cells. Host cells can include cultured cell lines, primary cells and proliferative cells. These host cells can include any of a variety of animal cells, such as mammalian, avian and insect cells and tissues that are susceptible to the virus, such as vaccinia virus, infection, including chicken embryo, rabbit, hamster and monkey kidney cells. Suitable host cells include but are not limited to hematopoietic cells (totipotent, stem cells, leukocytes, lymphocytes, monocytes, macrophages, APC, dendritic cells, non-human cells and the like), pulmonary cells, tracheal cells, hepatic cells, epithelial cells, endothelial cells, muscle cells (e.g., skeletal muscle, cardiac muscle or smooth muscle), fibroblasts, and cell lines including, for example, CV-1, BSC40, Vero, BSC40 and BSC-1, and human HeLa cells. Methods for transforming these host cells, phenotypically selecting transformants, and other such methods are known in the art.

3. Combinations

Provided are combinations of the viruses provided herein and a second agent, such as a second virus or other therapeutic or diagnostic agent, such as a transporter substrate protein. A combination can include any virus or reagent for effecting attenuation thereof in accord with the methods provided herein. Combinations can include a virus provided herein with one or more additional viruses. Combinations of the viruses provided can also contain pharmaceutical compositions containing the viruses or host cells containing the viruses as described herein.

In one embodiment, the virus in a combination is an attenuated virus, such as for example, an attenuated vaccinia virus that encodes a transporter protein. Exemplary attenuated viruses include vaccinia viruses provided herein, such as, but not limited to, for example, vaccinia viruses described in the Examples (e.g., GLV-1h99, GLV-1h100, GLV-1h101, GLV-1h139, GLV-1h146 and GLV-1h150, GLV-1h151, GLV-1h152 and GLV-1h153).

Combinations provided herein can contain a virus and a therapeutic compound. Therapeutic compounds for the compositions provided herein can be, for example, an anti-cancer or chemotherapeutic compound. Exemplary therapeutic compounds include, for example, cytokines, growth factors, photosensitizing agents, radionuclides, toxins, siRNA molecules, enzyme/pro E drug pairs, anti-metabolites, signaling modulators, anti-cancer antibiotics, anti-cancer antibodies, angiogenesis inhibitors, chemotherapeutic compounds or a combination thereof. Viruses provided herein can be combined with an anti-cancer compound, such as a platinum coordination complex. Exemplary platinum coordination complexes include, for example, cisplatin, carboplatin, oxaliplatin, DWA2114R, NK121, IS 3 295, and 254-S. Additional exemplary therapeutic compounds for the use in pharmaceutical composition combinations can be found elsewhere herein (see e.g., Section I for exemplary cytokines, growth factors, photosensitizing agents, radionuclides, toxins, siRNA molecules, enzyme/pro-drug pairs, anti-metabolites, signaling modulators, anti-cancer antibiotics, anti-cancer antibodies, angiogenesis inhibitors, and chemotherapeutic compounds). Exemplary chemotherapeutic agents include methotrexate, vincristine, adriamycin, non-sugar containing chloroethylnitrosoureas, 5-fluorouracil, mitomycin C, bleomycin, doxorubicin, dacarbazine, taxol, fragyline, Meglamine GLA, valrubicin, carmustaine and poliferposan, MM 1270, BAY 12-9566, RAS famesyl transferase inhibitor, famesyl transferase inhibitor, MMP, MTA/LY231514, LY264618/Lometexol, Glamolec, TNP-470, HYCAMTIN/Topotecan, PKC412, Valspodar/PSC833, NOVANTRONE/Mitroxantrone, Metaret/Suramin, Batimastat, E7070, BCH-4556, CS-682, 9-AC, AG3340, AG3433, Incel/VX-710, VX-853, ZD0101, IS1641, ODN 698, TA 2516/Marmistat, BB2516/Marmistat, CDP 845, D2163, PD183805, DX8951f, LEMONAL DP 2202, FK 317, Picibanil/OK-432, AD 32/Valrubicin, METASTRON/strontium derivative, Temodal/Temozolomide, Evacet/liposomal doxorubicin, Yewtaxan/Placlitaxel, Taxol/Paclitaxel, Xeload/Capecitabine, Furtulon/Doxifluridine, Cyclopax/oral paclitaxel, Oral Taxoid, SPU-077/Cisplatin, HMR 1275/Flavopiridol, CP-358 (774)/EGFR, CP-609 (754)/RAS oncogene inhibitor, BMS-182751/oral platinum, UFT(Tegafur/Uracil), Ergamisol/Levamisole, Eniluracil/776C85/5FU enhancer, Campto/Levamisole, CAMPTOSAR/Irinotecan, Tumodex/Ralitrexed, LEUSTATIN/Cladribine, Paxex/Paclitaxel, DOXIL/liposomal doxorubicin, Caelyx/liposomal doxorubicin, FLUDARA/Fludarabine, Pharmarubicin/Epirubicin, DEPOCYT, ZD1839, LU 79553/Bis-Naphtalimide, LU 103793/Dolastain, Caetyx/liposomal doxorubicin, GEMZAR/Gemcitabine, ZD 0473/ANORMED, YM 116, Iodine seeds, CDK4 and CDK2 inhibitors, PARP inhibitors, D4809/Dexifosamide, Ifes/MESNEX/Ifosamide, VUMON/Teniposide, Paraplatin/Carboplatin, Plantinol/cisplatin, Vepeside/Etoposide, ZD 9331, TAXOTERE/Docetaxel, prodrug of guanine arabinoside, Taxane Analog, nitrosoureas, alkylating agents such as melphelan and cyclophosphamide, Aminoglutethimide, Asparaginase, Busulfan, Carboplatin, Chlorombucil, Cytarabine HCl, Dactinomycin, Daunorubicin HCl, Estramustine phosphate sodium, Etoposide (VP16-213), Floxuridine, Fluorouracil (5-FU), Flutamide, Hydroxyurea (hydroxycarbamide), Ifosfamide, Interferon Alfa-2a, Alfa-2b, Leuprolide acetate (LHRH-releasing factor analogue), Lomustine (CCNU), Mechlorethamine HCl (nitrogen mustard), Mercaptopurine, Mesna, Mitotane (o.p'-DDD), Mitoxantrone HCl, Octreotide, Plicamycin, Procarbazine HCl, Streptozocin, Tamoxifen citrate, Thioguanine, Thiotepa, Vinblastine sulfate, Amsacrine (m-AMSA), Azacitidine, Erythropoietin, Hexamethylmelamine (HMM), Interleukin 2, Mitoguazone (methyl-GAG; methyl glyoxal bis-guanylhydrazone; MGBG), Pentostatin (2'deoxycoformycin), Semustine (methyl-CCNU), Teniposide (VM-26) and Vindesine sulfate.

In a further embodiment, the combination can include additional therapeutic compounds such as, for example, compounds that are substrates for enzymes encoded and expressed by the virus, or other therapeutic compounds provided herein or known in the art to act in concert with a virus. For example, the virus can express an enzyme that converts a prodrug into an active chemotherapy drug for killing the cancer cell. Hence, combinations provided herein can contain therapeutic compounds, such as prodrugs. An exemplary virus/therapeutic compound combination can include a virus encoding Herpes simplex virus thymidine kinase with the prodrug gancyclovir. Additional exemplary enzyme/pro-drug pairs, for the use in combinations provided include, but are not limited to, varicella zoster thymidine kinase/gancyclovir, cytosine deaminase/5-fluorouracil, purine nucleoside phosphorylase/6-methylpurine deoxyriboside, beta lactamase/cephalosporin-doxorubicin, carboxypeptidase G2/4-[(2-chloroethyl)(2-mesuloxyethyl)amino]benzoyl-L-glutamic acid, cytochrome P450/acetominophen, horseradish peroxidase/indole-3-acetic acid, nitroreductase/CB 1954, rabbit carboxylesterase/7-ethyl-10-[4-(1-piperidino)-1-piperidino] carbonyloxycampotothecin, mushroom tyrosinase/bis-(2-chloroethyl)amino-4-hydroxyphenylaminomethanone 28, beta galactosidase/1-chloromethyl-5-hydroxy-1,2-dihyro-3H-benz[e]indole, beta glucuronidase/epirubicin-glucoronide, thymidine phosphorylase/5'-deoxy5-fluorouridine, deoxycytidine kinase/cytosine arabinoside, beta-lactamase and linamerase/linamarin. Additional exemplary prodrugs, for the use in combinations can also be found elsewhere herein (see e.g., Section I). Any of a variety of known combinations provided herein or otherwise known in the art can be included in the combinations provided herein.

In a further embodiment, combinations can include compounds that can kill or inhibit viral growth or toxicity. Combinations provided herein can contain antibiotic, antifungal, anti-parasitic or antiviral compounds for treatment of infections. Exemplary antibiotics which can be included in a combination with a virus provided herein include, but are not limited to, ceftazidime, cefepime, imipenem, aminoglycoside, vancomycin and antipseudomonal β-lactam. Exemplary antifungal agents which can be included in a combination with a virus provided herein include, but are not limited to, amphotericin B, dapsone, fluconazole, flucytosine, griseofluvin, intraconazole, ketoconazole, miconazole, clotrimazole, nystatin, and combinations thereof. Exemplary antiviral agents can be included in a combination with a virus provided herein include, but are not limited to, cidofovir, alkoxyalkyl esters of cidofovir (CDV), cyclic CDV, and (S)-9-(3-hydroxy-2 phosphonylmethoxypropyl) adenine, 5-(Dimethoxymethyl)-2'-deoxyuridine, isatin-beta-thiosemicarbazone, N-methanocarbathymidine, brivudin, 7-deazaneplanocin A, ST-246 (Tecovirimat), GLEEVEC, 2'-beta-fluoro-2',3'-dideoxyadenosine, indinavir, nelfinavir, ritonavir, nevirapine, AZT, ddI, ddC, and combinations thereof. Typically, combinations with an antiviral agent contain an antiviral agent known to be effective against the virus of the combination. For example, combinations can contain a vaccinia virus with an antiviral compound, such as cidofovir, alkoxyalkyl esters of cidofovir, gancyclovir, acyclovir, ST-246 (Tecovirimat), and GLEEVEC.

In another embodiment, the combination can further include a detectable compound. A detectable compound can include a ligand or substrate or other compound that can interact with and/or bind specifically to a virally expressed protein or RNA molecule, and can provide a detectable signal, such as a signal detectable by tomographic, spectroscopic, magnetic resonance, or other known techniques. Exemplary detectable compounds can be, or can contain, an imaging agent such as a magnetic resonance, ultrasound or tomographic imaging agent, including a radionuclide. The detectable compound can include any of a variety of compounds as provided elsewhere herein or are otherwise known in the art. Typically, the detectable compound included with a virus in the combinations provided herein will be a compound that is a substrate, a ligand, or can otherwise specifically interact with, a protein or RNA encoded by the virus; in some examples, the protein or RNA is an exogenous protein or RNA. Exemplary viruses/detectable compounds include a virus encoding luciferase/luciferin, β-galactosidase/(4,7,10-tri(acetic acid)-1-(2-β-galactopyranosylethoxy)-1,4,7,10-tetraazacyclododecane) gadolinium (Egad), and other combinations known in the art.

In another embodiment, the combination can further include a virus gene expression modulating compound. Compounds that modulate gene expression are known in the art, and include, but are not limited to, transcriptional activators, inducers, transcriptional suppressors, RNA polymerase inhibitors and RNA binding compounds such as siRNA or ribozymes. Any of a variety of gene expression modulating compounds known in the art can be included in the combinations provided herein. Typically, the gene expression modulating compound included with a virus in the combinations provided herein will be a compound that can bind, inhibit or react with one or more compounds, active in gene expression such as a transcription factor or RNA of the virus of the combination. An exemplary virus/expression modulator can be a virus encoding a chimeric transcription factor complex having a mutant human progesterone receptor fused to a yeast GAL4 DNA-binding domain an activation domain of the herpes simplex virus protein VP16 and also containing a synthetic promoter containing a series of GAL4 recognition sequences upstream of the adenovirus major late E1B TATA box, where the compound can be RU486 (see, e.g., Yu et al., (2002) *Mol Genet Genomics* 268:169-178). A variety of other virus/expression modulator combinations known in the art also can be included in the combinations provided herein.

In a further embodiment, combination can further contain nanoparticles. Nanoparticles can be designed such that they carry one or more therapeutic agents provided herein. Additionally, nanoparticles can be designed to carry a molecule that targets the nanoparticle to the tumor cells. In one non-limiting example, nanoparticles can be coated with a radionuclide and, optionally, an antibody immunoreactive with a tumor-associated antigen.

4. Kits

The viruses, cells, pharmaceutical compositions or combinations provided herein can be packaged as kits. Kits can optionally include one or more components such as instructions for use, devices and additional reagents, and components, such as tubes, containers and syringes for practice of the methods. Exemplary kits can include the viruses provided herein, and can optionally include instructions for use, a device for detecting a virus in a subject, a device for administering the virus to a subject, and a device for administering a compound to a subject.

In one example, a kit can contain instructions. Instructions typically include a tangible expression describing the virus and, optionally, other components included in the kit, and methods for administration, including methods for determining the proper state of the subject, the proper dosage amount, and the proper administration method, for administering the virus. Instructions can also include guidance for monitoring the subject over the duration of the treatment time.

In another example, a kit can contain a device for detecting a virus in a subject. Devices for detecting a virus in a subject can include a low light imaging device for detecting light, for example, emitted from luciferase, or fluoresced from fluorescent protein, such as a green or red fluorescent protein, a magnetic resonance measuring device such as an MRI or NMR device, a tomographic scanner, such as a PET, CT, CAT, SPECT or other related scanner, an ultrasound device, or other device that can be used to detect a protein expressed by the virus within the subject. Typically, the device of the kit will be able to detect one or more proteins expressed by the virus of the kit. Any of a variety of kits containing viruses and detection devices can be included in the kits provided herein, for example, a virus expressing luciferase and a low light imager or a virus expressing fluorescent protein, such as a green or red fluorescent protein, and a low light imager.

Kits provided herein also can include a device for administering a virus to a subject. Any of a variety of devices known in the art for administering medications or vaccines can be included in the kits provided herein. Exemplary devices include, but are not limited to, a hypodermic needle, an intravenous needle, a catheter, a needle-less injection device, an inhaler and a liquid dispenser, such as an eyedropper. Typically, the device for administering a virus of the kit will be compatible with the virus of the kit; for example, a needle-less injection device such as a high pressure injection device can be included in kits with viruses not damaged by high pressure injection, but is typically not included in kits with viruses damaged by high pressure injection.

Kits provided herein also can include a device for administering a compound to a subject. Any of a variety of devices known in the art for administering medications to a subject can be included in the kits provided herein. Exemplary devices include a hypodermic needle, an intravenous needle, a catheter, a needle-less injection, but are not limited to, a hypodermic needle, an intravenous needle, a catheter, a needle-less injection device, an inhaler and a liquid dispenser such as an eyedropper. Typically the device for administering the compound of the kit will be compatible with the desired method of administration of the compound. For example, a compound to be delivered subcutaneously can be included in a kit with a hypodermic needle and syringe.

I. Diagnostic and Therapeutic Methods

Provided are diagnostic and therapeutic methods, including methods of detecting, imaging, treating and/or preventing immunoprivileged cells or tissue, including cancerous cells, tumors and metastases. Such sites, diseases and disorders include sites of cell proliferation, proliferative conditions, neoplasms, tumors, neoplastic disease, wounds and inflammation. The diagnostic and therapeutic methods provided herein include, but are not limited to, administering a virus provided herein that encodes a transporter protein to a subject containing a tumor and/or metastases. Viruses provided herein include viruses that have been modified using the methods provided herein to generate viruses that encode transporter proteins. Target cells that are infected with such viruses express the transporter proteins, which permits uptake of corresponding transporter substrates, which can be diagnostic and or therapeutic agents or conjugated to a diagnostic or therapeutic agents. Selection and modification of such transporter substrates are described elsewhere herein. The uptake of labeled substrates by virally infected tumor cells allows visualization of the tumor tissue and can be used to monitor tumor therapy.

The administered viruses also can posses one or more characteristics including attenuated pathogenicity, low toxicity, preferential accumulation in tumor, ability to activate an immune response against tumor cells, immunogenicity, replication competence, ability to express additional exogenous diagnostic and/or therapeutic genes, and an ability to elicit antibody production against an expressed gene product. The viruses can be administered for diagnosis and/or therapy of subjects, such as, but not limited to humans and other mammals, including rodents, dogs, cats, primates, or livestock.

The viruses provided herein can accumulate in tumors or metastases. In some examples, the administration of a virus provided herein results in a slowing of tumor growth. In other examples, the administration of a virus provided herein results in a decrease in tumor volume. The therapeutic methods provided herein, however, do not require the administered virus to kill tumor cells or decrease the tumor size. Instead, the methods provided herein include administering to a subject a virus provided herein that can cause or enhance an anti-tumor immune response in the subject. In some examples, the viruses provided herein can be administered to a subject without causing viral-induced disease in the subject. In some examples, the viruses can elicit an anti-tumor immune response in the subject, where typically the viral-mediated anti-tumor immune response can develop, for example, over several days, a week or more, 10 days or more, two weeks or more, or a month or more. In some exemplary methods, the virus can be present in the tumor, and can cause an anti-tumor immune response without the virus itself causing enough tumor cell death to prevent tumor growth. In some examples, the tumor is a monotherapeutic tumor or monotherapeutic cancer, where the tumor or cancer does not decrease in volume when treated with the virus or a therapeutic agent alone.

In some examples, provided herein are methods for eliciting or enhancing antibody production against a selected antigen or a selected antigen type in a subject, where the methods include administering to a subject a virus that can accumulate in a tumor and/or metastasis, and can cause release of a selected antigen or selected antigen type from the tumor, resulting in antibody production against the selected antigen or selected antigen type. Any of a variety of antigens can be targeted in the methods provided herein, including a selected antigen such as an exogenous gene product expressed by the virus, or a selected antigen type such as one or more tumor antigens release from the tumor as a result of viral infection of the tumor (e.g., by lysis, apoptosis, secretion or other mechanism of causing antigen release from the tumor).

In some embodiments, it can be desirable to maintain release of the selected antigen or selected antigen type over a series of days, for example, at least a week, at least ten days, at least two weeks or at least a month. Provided herein are methods for providing a sustained antigen release within a subject, where the methods include administering to a subject a virus that can accumulate in a tumor and/or metastasis, and can cause sustained release of an antigen, resulting in antibody production against the antigen. The sustained release of antigen can result in an immune response by the viral-infected host, in which the host can develop antibodies against the antigen, and/or the host can mount an immune response against cells expressing the antigen, including an immune response against tumor cells. Thus, the sustained release of antigen can result in immunization against tumor cells. In some embodiments, the viral-mediated sustained antigen release-induced immune response against tumor cells can result in complete removal or killing of all tumor cells.

In some embodiments, the therapeutic methods provided herein inhibit tumor growth in a subject, where the methods include administering to a subject a virus that can accumulate in a tumor and/or metastasis, and can cause or enhance an anti-tumor immune response. The anti-tumor immune response induced as a result of tumor or metastases-accumulated viruses can result in inhibition of tumor growth.

In some embodiments, the therapeutic methods provided herein inhibit growth or formation of a metastasis in a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in inhibition of metastasis growth or formation.

In other embodiments, the therapeutic methods provided herein decrease the size of a tumor and/or metastasis in a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in a decrease in the size of the tumor and/or metastasis.

In some embodiments, the therapeutic methods provided herein eliminate a tumor and/or metastasis from a subject, where the methods include administering to a subject a virus provided herein that can accumulate in a tumor and/or metastasis, and can cause or enhance an anti-tumor immune response. The anti-tumor immune response induced as a result of tumor or metastasis-accumulated viruses can result in elimination of the tumor and/or metastasis from the subject.

Methods of reducing or inhibiting tumor growth, inhibiting metastasis growth and/or formation, decreasing the size of a tumor or metastasis, eliminating a tumor or metastasis, or other tumor therapeutic methods provided herein include causing or enhancing an anti-tumor immune response in the host. The immune response of the host, being anti-tumor in nature, can be mounted against tumors and/or metastases in which viruses have accumulated, and can also be mounted against tumors and/or metastases in which viruses have not accumulated, including tumors and/or metastases that form after administration of the virus to the subject. Accordingly, a tumor and/or metastasis whose growth or formation is inhibited, or whose size is decreased, or that is eliminated, can be a tumor and/or metastasis in which the viruses have accumulated, or also can be a tumor and/or metastasis in which the viruses have not accumulated. Accordingly, provided herein are methods of reducing or inhibiting tumor growth, inhibiting metastasis growth and/or formation, decreasing the size of a tumor or metastasis, eliminating a tumor or metastasis, or other tumor therapeutic methods, where the method includes administering to a subject a virus provided herein, where the virus accumulates in at least one tumor or metastasis and causes or enhances an anti-tumor immune response in the subject, and the immune response also is mounted against a tumor and/or metastasis in which the virus cell did not accumulate. In another embodiment, methods are provided for inhibiting or preventing recurrence of a neoplastic disease or inhibiting or preventing new tumor growth, where the methods include administering to a subject a virus provided herein that can accumulate in a tumor and/or metastasis, and can cause or enhance an anti-tumor immune response, and the anti-tumor immune response can inhibit or prevent recurrence of a neoplastic disease or inhibit or prevent new tumor growth.

The tumor or neoplastic disease therapeutic methods provided herein, such as methods of reducing or inhibiting tumor growth, inhibiting metastasis growth and/or formation, decreasing the size of a tumor or metastasis, eliminating a tumor or metastasis, or other tumor therapeutic methods, also can include administering to a subject a virus provided herein that can cause tumor cell lysis or tumor cell death. Such a virus can be the same virus as the virus that can cause or enhance an anti-tumor immune response in the subject. Viruses, such as the viruses provided herein, can cause cell lysis or tumor cell death as a result of expression of an endogenous gene or as a result of an exogenous gene. Endogenous or exogenous genes can cause tumor cell lysis or inhibit cell growth as a result of direct or indirect actions, as is known in the art, including lytic channel formation or activation of an apoptotic pathway. Gene products, such as exogenous gene products can function to activate a prodrug to an active, cytotoxic form, resulting in cell death where such genes are expressed.

Such methods of antigen production or tumor and/or metastasis treatment can include administration of a virus provided herein for therapy, such as for gene therapy, for cancer gene therapy, or for vaccine therapy. Such a virus can be used to stimulate humoral and/or cellular immune response, induce strong cytotoxic T lymphocytes responses in subjects who can benefit from such responses. For example, the virus can provide prophylactic and therapeutic effects against a tumor infected by the virus or other infectious diseases, by rejection of cells from tumors or lesions using viruses that express immunoreactive antigens (Earl et al., *Science* 234: 728-831 (1986); Lathe et al., *Nature* (London) 32: 878-880 (1987)), cellular tumor-associated antigens (Bernards et al., *Proc. Natl. Acad. Sci. USA* 84: 6854-6858 (1987); Estin et al., *Proc. Natl. Acad. Sci. USA* 85: 1052-1056 (1988); Kantor et al., *J. Natl. Cancer Inst.* 84: 1084-1091 (1992); Roth et al., *Proc. Natl. Acad. Sci. USA* 93: 4781-4786 (1996)) and/or cytokines (e.g., IL-2, IL-12), costimulatory molecules (B7-1, B7-2) (Rao et al., *J. Immunol.* 156: 3357-3365 (1996); Chamberlain et al., *Cancer Res.* 56: 2832-2836 (1996); Oertli et al., *J. Gen. Virol.* 77: 3121-3125 (1996); Qin and Chatterjee, *Human Gene Ther.* 7: 1853-1860 (1996); McAneny et al., *Ann. Surg. Oncol.* 3: 495-500 (1996)), or other therapeutic proteins.

As shown previously, solid tumors can be treated with viruses, such as vaccinia viruses, resulting in an enormous tumor-specific virus replication, which can lead to tumor protein antigen and viral protein production in the tumors (U.S. Patent Publication No. 2005/0031643). Vaccinia virus administration to mice resulted in lysis of the infected tumor cells and a resultant release of tumor-cell-specific antigens. Continuous leakage of these antigens into the body led to a very high level of antibody titer (in approximately 7-14 days) against tumor proteins, viral proteins, and the virus encoded engineered proteins in the mice. The newly synthesized anti-tumor antibodies and the enhanced macrophage, neutrophils count were continuously delivered via the vasculature to the tumor and thereby provided for the recruitment of an activated immune system against the tumor. The activated immune system then eliminated the foreign compounds of the tumor including the viral particles. This interconnected release of foreign antigens boosted antibody production and continuous response of the antibodies against the tumor proteins to function like an autoimmunizing vaccination system initiated by vaccinia viral infection and replication, followed by cell lysis, protein leakage and enhanced antibody production. Thus, the viruses provided herein and the viruses generated using the methods provided herein can be administered in a complete process that can be applied to all tumor systems with immunoprivileged tumor sites as site of privileged viral growth, which can lead to tumor elimination by the host's own immune system.

In other embodiments, methods are provided for immunizing a subject, where the methods include administering to the subject a virus that expresses one or more antigens against which antigens the subject will develop an immune response. The immunizing antigens can be endogenous to the virus, such as vaccinia antigens on a vaccinia virus used to immunize against smallpox, measles, mumps, or the immunizing antigens can be exogenous antigens expressed by the virus, such as influenza or HIV antigens expressed on a viral capsid surface. In the case of smallpox, for example, a tumor specific protein antigen can be carried by an attenuated vaccinia virus (encoded by the viral genome) for a smallpox vaccine. Thus, the viruses provided herein, including the modified vaccinia viruses can be used as vaccines.

In one embodiment, the tumor treated is a cancer such as pancreatic cancer, non-small cell lung cancer, multiple myeloma or leukemia, although the cancer is not limited in this respect, and other metastatic diseases can be treated by the combinations provided herein. For example, the tumor treated can be a solid tumor, such as of the lung and bronchus, breast, colon and rectum, kidney, stomach, esophagus, liver and intrahepatic bile duct, urinary bladder, brain and other nervous system, head and neck, oral cavity and pharynx, cervix, uterine corpus, thyroid, ovary, testes, prostate, malignant melanoma, cholangiocarcinoma, thymoma, non-melanoma skin cancers, as well as hematologic tumors and/or malignancies, such as childhood leukemia and lymphomas, multiple myeloma, Hodgkin's disease, lymphomas of lymphocytic and cutaneous origin, acute and chronic leukemia such as acute lymphoblastic, acute myelocytic or chronic myelocytic leukemia, plasma cell neoplasm, lymphoid neoplasm and cancers associated with AIDS. Exemplary tumors include, for example, pancreatic tumors, ovarian tumors, lung tumors, colon tumors, prostate tumors, cervical tumors and breast tumors. In one embodiment, the tumor is a carcinoma such as, for example, an ovarian tumor or a pancreatic tumor.

1. Administration

In performing the therapeutic methods provided herein, a virus provided herein that encodes a transporter protein can be administered to a subject, including a subject having a tumor or having neoplastic cells, or a subject to be immunized. An administered virus can be a virus provided herein or any other virus generated using the methods provided herein. In some embodiments, the virus administered is a virus containing a characteristic such as attenuated pathogenicity, low toxicity, preferential accumulation in tumor, ability to activate an immune response against tumor cells, high immunogenicity, replication competence and ability to express exogenous proteins, and combinations thereof. A substrate that is transported by the transporter protein can be administered simultaneously or sequentially to administration of the virus for detection, imaging or treatment.

a. Steps Prior to Administering the Virus

In some embodiments, one or more steps can be performed prior to administration of the virus to the subject. Any of a variety of preceding steps can be performed, including, but not limited to diagnosing the subject with a condition appropriate for virus administration, determining the immunocompetence of the subject, immunizing the subject, treating the subject with a chemotherapeutic agent, treating the subject with radiation, or surgically treating the subject.

For embodiments that include administering a virus to a tumor-bearing subject for therapeutic purposes, the subject has typically been previously diagnosed with a neoplastic condition. Diagnostic methods also can include determining the type of neoplastic condition, determining the stage of the neoplastic conditions, determining the size of one or more tumors in the subject, determining the presence or absence of metastatic or neoplastic cells in the lymph nodes of the subject, or determining the presence of metastases of the subject. Some embodiments of therapeutic methods for administering a virus to a subject can include a step of determination of the size of the primary tumor or the stage of the neoplastic disease, and if the size of the primary tumor is equal to or above a threshold volume, or if the stage of the neoplastic disease is at or above a threshold stage, a virus is administered to the subject. In a similar embodiment, if the size of the primary tumor is below a threshold volume, or if the stage of the neoplastic disease is at or below a threshold stage, the virus is not yet administered to the subject; such methods can include monitoring the subject until the tumor size or neoplastic disease stage reaches a threshold amount, and then administering the virus to the subject. Threshold sizes can vary according to several factors, including rate of growth of the tumor, ability of the virus to infect a tumor, and immunocompetence of the subject. Generally the threshold size will be a size sufficient for a virus to accumulate and replicate in or near the tumor without being completely removed by the host's immune system, and will typically also be a size sufficient to sustain a virus infection for a time long enough for the host to mount an immune response against the tumor cells, typically about one week or more, about ten days or more, or about two weeks or more. Exemplary threshold tumor sizes for viruses, such as vaccinia viruses, are at least about 100 mm$^3$, at least about 200 mm$^3$, at least about 300 mm$^3$, at least about 400 mm$^3$, at least about 500 mm$^3$, at least about 750 mm$^3$, at least about 1000 mm$^3$, or at least about 1500 mm$^3$. Threshold neoplastic disease stages also can vary according to several factors, including specific requirement for staging a particular neoplastic disease, aggressiveness of growth of the neoplastic disease, ability of the virus to infect a tumor or metastasis, and immunocompetence of the subject. Generally the threshold stage will be a stage sufficient for a virus to accumulate and replicate in a tumor or metastasis without being completely removed by the host's immune system, and will typically also be a size sufficient to sustain a virus infection for a time long enough for the host to mount an immune response against the neoplastic cells, typically about one week or more, about ten days or more, or about two weeks or more. Exemplary threshold stages are any stage beyond the lowest stage (e.g., Stage I or equivalent), or any stage where the primary tumor is larger than a threshold size, or any stage where metastatic cells are detected.

In other embodiments, prior to administering to the subject a virus, the immunocompetence of the subject can be determined. The methods of administering a virus to a subject provided herein can include causing or enhancing an immune response in a subject. Accordingly, prior to administering a virus to a subject, the ability of a subject to mount an immune response can be determined. Any of a variety of tests of immunocompetence known in the art can be performed in the methods provided herein. Exemplary immunocompetence tests can examine ABO hemagglutination titers (IgM), leukocyte adhesion deficiency (LAD), granulocyte function (NBT), T and B cell quantitation, tetanus antibody titers, salivary IgA, skin test, tonsil test, complement C3 levels, and factor B levels, and lymphocyte count. One skilled in the art can determine the desirability to administer a virus to a subject according to the level of immunocompetence of the subject, according to the immunogenicity of the virus, and, optionally, according to the immunogenicity of the neoplastic disease to be treated. Typically, a subject can be considered immunocompetent if the skilled artisan can determine that the subject is sufficiently competent to mount an immune response against the virus.

In some embodiments, the subject can be immunized prior to administering to the subject a virus according to the methods provided herein. Immunization can serve to increase the ability of a subject to mount an immune response against the virus, or increase the speed at which the subject can mount an immune response against a virus. Immunization also can serve to decrease the risk to the subject of pathogenicity of the virus. In some embodiments, the immunization can be performed with an immunization virus that is similar to the therapeutic virus to be administered. For example, the immunization virus can be a replication-incompetent variant of the therapeutic virus. In other embodiments, the immunization material can be digests of the therapeutic virus to be administered. Any of a variety of methods for immunizing a subject against a known virus are known in the art and can be used herein. In one example, vaccinia viruses treated with, for example, 1 microgram of psoralen and ultraviolet light at 365 nm for 4 minutes, can be rendered replication incompetent. In another embodiment, the virus can be selected as the same or similar to a virus against which the subject has been previously immunized, e.g., in a childhood vaccination.

In another embodiment, the subject can have administered thereto a virus without any previous steps of cancer treatment such as chemotherapy, radiation therapy or surgical removal of a tumor and/or metastases. The methods provided herein take advantage of the ability of the viruses to enter or localize near a tumor, where the tumor cells can be protected from the subject's immune system; the viruses can then proliferate in such an immunoprotected region and can also cause the release, typically a sustained release, of tumor antigens from the tumor to a location in which the subject's immune system can recognize the tumor antigens and mount an immune response. In such methods, existence of a tumor of sufficient size or sufficiently developed immunoprotected state can be advantageous for successful administration of the virus to the tumor, and for sufficient tumor antigen production. If a tumor is surgically removed, the viruses may not be able to localize to other neoplastic cells (e.g., small metastases) because such cells have not yet have matured sufficiently to create an immunoprotective environment in which the viruses can survive and proliferate, or even if the viruses can localize to neoplastic cells, the number of cells or size of the mass can be too small for the viruses to cause a sustained release of tumor antigens in order for the host to mount an anti-tumor immune response. Thus, for example, provided herein are methods of treating a tumor or neoplastic disease in which viruses are administered to a subject with a tumor or neoplastic disease without removing the primary tumor, or to a subject with a tumor or neoplastic disease in which at least some tumors or neoplastic cells are intentionally permitted to remain in the subject. In other typical cancer treatment methods such as chemotherapy or radiation therapy, such methods typically have a side effect of weakening the subject's immune system. This treatment of a subject by chemotherapy or radiation therapy can reduce the subject's ability to mount an anti-tumor immune response. Thus, for example, provided herein are methods of treating a tumor or neoplastic disease in which viruses are administered to a subject with a tumor or neoplastic disease without treating the subject with an immune system-weakening therapy, such as chemotherapy or radiation therapy.

In an alternative embodiment, prior to administration of a virus to the subject, the subject can be treated in one or more cancer treatment steps that do not remove the primary tumor or that do not weaken the immune system of the subject. A variety of more sophisticated cancer treatment methods are being developed in which the tumor can be treated without surgical removal or immune-system weakening therapy. Exemplary methods include administering a compound that decreases the rate of proliferation of the tumor or neoplastic cells without weakening the immune system (e.g., by administering tumor suppressor compounds or by administering tumor cell-specific compounds) or administering an angiogenesis-inhibiting compound. Thus, combined methods that include administering a virus to a subject can further improve cancer therapy. Thus, provided herein are methods of administering a virus to a subject, along with prior to or subsequent to, for example, administering a compound that slows tumor growth without weakening the subject's immune system or a compound that inhibits vascularization of the tumor.

b. Mode of Administration

Any mode of administration of a virus to a subject can be used, provided the mode of administration permits the virus to enter a tumor or metastasis. Modes of administration can include, but are not limited to, systemic, intravenous, intraperitoneal, subcutaneous, intramuscular, transdermal, intradermal, intra-arterial (e.g., hepatic artery infusion), intravesicular perfusion, intrapleural, intraarticular, topical, intratumoral, intralesional, multipuncture (e.g., as used with smallpox vaccines), inhalation, percutaneous, subcutaneous, intranasal, intratracheal, oral, intracavity (e.g., administering to the bladder via a catheter, administering to the gut by suppository or enema), vaginal, rectal, intracranial, intraprostatic, intravitreal, aural, or ocular administration. Transporter substrate also can be similarly administered. In some examples, both the virus and transporter substrates are administered systemically for detection, imaging and/or treatment of a tumor.

One skilled in the art can select any mode of administration compatible with the subject and the virus, and that also is likely to result in the virus reaching tumors and/or metastases. The route of administration can be selected by one skilled in the art according to any of a variety of factors, including the nature of the disease, the kind of tumor, and the particular virus contained in the pharmaceutical composition. Administration to the target site can be performed, for example, by ballistic delivery, as a colloidal dispersion system, or systemic administration can be performed by injection into an artery.

c. Dosages

The dosage regimen can be any of a variety of methods and amounts, and can be determined by one skilled in the art according to known clinical factors. As is known in the medical arts, dosages for any one patient can depend on many factors, including the subject's species, size, body surface area, age, sex, immunocompetence, and general health, the particular virus to be administered, duration and route of administration, the kind and stage of the disease, for example, tumor size, and other treatments or compounds, such as chemotherapeutic drugs, being administered concurrently. In addition to the above factors, such levels can be affected by the infectivity of the virus, and the nature of the virus, as can be determined by one skilled in the art. In the present methods, appropriate minimum dosage levels of viruses can be levels sufficient for the virus to survive, grow and replicate in a tumor or metastasis. Exemplary minimum levels for administering a virus to a 65 kg human can include at least about $1\times10^5$ plaque forming units (PFU), at least about $5\times10^5$ PFU, at least about $1\times10^6$ PFU, at least about $5\times10^6$ PFU, at least about $1\times10^7$ PFU, at least about $1\times10^8$ PFU, at least about $1\times10^9$ PFU, or at least about $1\times10^{10}$ PFU. In the present methods, appropriate maximum dosage levels of viruses can be levels that are not toxic to the host, levels that do not cause splenomegaly of 3 times or more, levels that do not result in colonies or plaques in normal tissues or organs after about 1 day or after about 3 days or after about 7 days. Exemplary maximum levels for administering a virus to a 65 kg human can include no more than about $1\times10^{11}$ PFU, no more than about $5\times10^{10}$ PFU, no more than about $1\times10^{10}$ PFU, no more than about $5\times10^9$ PFU, no more than about $1\times10^9$ PFU, or no more than about $1\times10^8$ PFU.

For combination therapies with chemotherapeutic compounds, dosages for the administration of such compounds are known in the art or can be determined by one skilled in the art according to known clinical factors (e.g., subject's species, size, body surface area, age, sex, immunocompetence, and general health, duration and route of administration, the kind and stage of the disease, for example, tumor size, and other viruses, treatments, or compounds, such as other chemotherapeutic drugs, being administered concurrently). In addition to the above factors, such levels can be affected by the infectivity of the virus, and the nature of the virus, as can be determined by one skilled in the art. For example, Cisplatin (also called cis-platinum, platinol; cis-diamminedichloro-platinum; and cDDP) is representative of a broad class of water-soluble, platinum coordination compounds frequently employed in the therapy of testicular cancer, ovarian tumors and a variety of other cancers. (See, e.g., Blumenreich et al. *Cancer* 55(5): 1118-1122 (1985); Forastiere et al. *J. Clin. Oncol.* 19(4): 1088-1095 (2001)). Methods of employing cisplatin clinically are well known in the art. For example, cisplatin has been administered in a single day over a six hour period, once per month, by slow intravenous infusion. For localized lesions, cisplatin can be administered by local injection. Intraperitoneal infusion can also be employed. Cisplatin can be administered in doses as low as 10 mg/m² per treatment if part of a multi-drug regimen, or if the patient has an adverse reaction to higher dosing. In general, a clinical dose is from about 30 to about 120 or 150 mg/m² per treatment.

Typically, platinum-containing chemotherapeutic agents are administered parenterally, for example by slow intravenous infusion, or by local injection, as discussed above. The effects of intralesional (intra-tumoral) and IP administration of cisplatin is described in (Nagase et al. *Cancer Treat. Rep.* 71(9): 825-829 (1987); and Theon et al. *J. Am. Vet. Med. Assoc.* 202(2): 261-7. (1993)).

In one exemplary embodiment, the mutant vaccinia virus is administered once or 2-4 times with 0-60 days apart, followed by 1-30 days where no anti-cancer treatment, then cisplatin is administered daily for 1-5 days, followed by 1-30 days where no anti-cancer treatment is administered. Each component of the therapy, virus or cisplatin treatment, or the virus and cisplatin combination therapy can be repeated. In another exemplary embodiment, cisplatin is administered daily for 1 to 5 days, followed by 1-10 days where no anti-cancer treatment is administered, then the mutant vaccinia virus is administered once or 2-4 times with 0-60 days apart. Such treatment scheme can be repeated. In another exemplary embodiment, cisplatin is administered daily for 1 to 5 days, followed by 1-10 days where no anti-cancer treatment is administered, then the mutant vaccinia virus is administered once or 2-4 times with 0-60 days apart. This is followed by 5-60 days where no anti-cancer treatment is administered, then cisplatin is administered again for 1-5 days. Such treatment scheme can be repeated.

Gemcitabine (GEMZAR®) is another compound employed in the therapy of breast cancer, non-small cell lung cancer, and pancreatic cancer. Gemcitabine is a nucleoside analogue that exhibits antitumor activity. Methods of employing gemcitabine clinically are well known in the art. For example, gemcitabine has been administered by intravenous infusion at a dose of 1000 mg/m² over 30 minutes once weekly for up to 7 weeks (or until toxicity necessitates reducing or holding a dose), followed by a week of rest from treatment of pancreatic cancer. Subsequent cycles can consist of infusions once weekly for 3 consecutive weeks out of every 4 weeks. Gemcitabine has also been employed in combination with cisplatin in cancer therapy.

In one exemplary embodiment, the mutant vaccinia virus is administered once or 2-4 times with 0-60 days apart, followed by 1-30 days where no anti-cancer treatment is administered, then gemcitabine is administered 1-7 times with 0-30 days apart, followed by 1-30 days where no anti-cancer treatment is administered. Such treatment scheme can be repeated. In another exemplary embodiment, gemcitabine is administered 1-7 times with 0-30 days apart, followed by 1-10 days where no anti-cancer treatment is administered, then the mutant vaccinia virus is administered once or 2-4 times with 0-60 days apart. This is followed by 5-60 days where no anti-cancer treatment is administered. Such treatment scheme can be repeated. In another exemplary embodiment, gemcitabine is administered 1-7 times with 0-30 days apart, followed by 1-10 days where no anti-cancer treatment is administered, then the mutant vaccinia virus is administered once or 2-4 times with 0-60 days apart. This is followed by 5-60 days where no anti-cancer treatment is administered, then gemcitabine is administered again for 1-7 times with 0-30 days apart. Such treatment scheme can be repeated.

As will be understood by one of skill in the art, the optimal treatment regimen will vary and it is within the scope of the treatment methods to evaluate the status of the disease under treatment and the general health of the patient prior to, and following one or more cycles of combination therapy in order to determine the optimal therapeutic combination.

d. Number of Administrations

The methods provided herein can include a single administration of a virus to a subject or multiple administrations of a virus to a subject. In some embodiments, a single administration is sufficient to establish a virus in a tumor, where the virus can proliferate and can cause or enhance an anti-tumor response in the subject; such methods do not require additional administrations of a virus in order to cause or enhance an anti-tumor response in a subject, which can result, for example in inhibition of tumor growth, inhibition of metastasis growth or formation, reduction in tumor or size, elimination of a tumor or metastasis, inhibition or prevention of recurrence of a neoplastic disease or new tumor formation, or other cancer therapeutic effects. In other embodiments, a virus can be administered on different occasions, separated in time typically by at least one day. Separate administrations can increase the likelihood of delivering a virus to a tumor or metastasis, where a previous administration has been ineffective in delivering a virus to a tumor or metastasis. Separate administrations can increase the locations on a tumor or metastasis where virus proliferation can occur or can otherwise increase the titer of virus accumulated in the tumor, which can increase the scale of release of antigens or other compounds from the tumor in eliciting or enhancing a host's anti-tumor immune response, and also can, optionally, increase the level of virus-based tumor lysis or tumor cell death. Separate administrations of a virus can further extend a subject's immune response against viral antigens, which can extend the host's immune response to tumors or metastases in which viruses have accumulated, and can increase the likelihood of a host mounting an anti-tumor immune response.

When separate administrations are performed, each administration can be a dosage amount that is the same or different relative to other administration dosage amounts. In one embodiment, all administration dosage amounts are the same. In other embodiments, a first dosage amount can be a larger dosage amount than one or more subsequent dosage amounts, for example, at least 10× larger, at least 100× larger, or at least 1000× larger than subsequent dosage amounts. In one example of a method of separate administrations in which the first dosage amount is greater than one or more subsequent dosage amounts, all subsequent dosage amounts can be the same, smaller amount relative to the first administration.

Separate administrations can include any number of two or more administrations, including two, three, four, five or six administrations. One skilled in the art can readily determine the number of administrations to perform or the desirability of performing one or more additional administrations according to methods known in the art for monitoring therapeutic methods and other monitoring methods provided herein. Accordingly, the methods provided herein include methods of providing to the subject one or more administrations of a virus, where the number of administrations can be determined by monitoring the subject, and, based on the results of the monitoring, determining whether or not to provide one or more additional administrations. Deciding on whether or not to provide one or more additional administrations can be based on a variety of monitoring results, including, but not limited to, indication of tumor growth or inhibition of tumor growth, appearance of new metastases or inhibition of metastasis, the subject's anti-virus antibody titer, the subject's anti-tumor antibody titer, the overall health of the subject, the weight of the subject, the presence of virus solely in tumor and/or metastases, the presence of virus in normal tissues or organs.

The time period between administrations can be any of a variety of time periods. The time period between administrations can be a function of any of a variety of factors, including monitoring steps, as described in relation to the number of administrations, the time period for a subject to mount an immune response, the time period for a subject to clear the virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

e. Co-Administrations

Also provided are methods in which an additional therapeutic substance, such as a different therapeutic virus or a therapeutic compound is administered. These can be administered simultaneously, sequentially or intermittently with the first virus. The additional therapeutic substance can interact with the virus or a gene product thereof, or the additional therapeutic substance can act independently of the virus.

Combination therapy treatment has advantages in that: 1) it avoids single agent resistance; 2) in a heterogeneous tumor population, it can kill cells by different mechanisms; and 3) by selecting drugs with non-overlapping toxicities, each agent can be used at full dose to elicit maximal efficacy and synergistic effect. Combination therapy can be done by combining a diagnostic/therapeutic virus with one or more of the following anti-cancer agents: chemotherapeutic agents, therapeutic antibodies, siRNAs, toxins, enzyme-prodrug pairs or radiation.

i. Administering a Plurality of Viruses

Methods are provided for administering to a subject two or more viruses. Administration can be effected simultaneously, sequentially or intermittently. The plurality of viruses can be administered as a single composition or as two or more compositions. The two or more viruses can include at least two viruses. In a particular embodiment, where there are two viruses, both viruses are vaccinia viruses. In another embodiment, one viruses is a vaccinia virus and the second viruses is any one of an adenovirus, an adeno-associated virus, a retrovirus, a herpes simplex virus, a reovirus, a mumps virus, a foamy virus, an influenza virus, a myxoma virus, a vesicular stomatitis virus, or any other virus described herein or known in the art. Viruses can be chosen based on the pathway on which they act. For example, a virus that targets an activated Ras pathway can be combined with a virus that targets tumor cells defective in p53 expression.

The plurality of viruses can be provided as combinations of compositions containing and/or as kits that include the viruses packaged for administration and optionally including instructions therefore. The compositions can contain the viruses formulated for single dosage administration (i.e., for direct administration) and can require dilution or other additions.

In one embodiment, at least one of the viruses is a modified virus such as those provided herein, having a characteristic such as low pathogenicity, low toxicity, preferential accumulation in tumor, ability to activate an immune response against tumor cells, immunogenic, replication competent, ability to express exogenous proteins, and combinations thereof. The viruses can be administered at approximately the same time, or can be administered at different times. The viruses can be administered in the same composition or in the same administration method, or can be administered in separate composition or by different administration methods.

The time period between administrations can be any time period that achieves the desired effects, as can be determined by one skilled in the art. Selection of a time period between administrations of different viruses can be determined according to parameters similar to those for selecting the time period between administrations of the same virus, including results from monitoring steps, the time period for a subject to mount an immune response, the time period for a subject to clear virus from normal tissue, or the time period for virus proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for a subject to clear the virus from normal tissue; for example, the time period can be more than the time period for a subject to clear the virus from normal tissue, such as more than about a day, more than about two days, more than about three days, more than about five days, or more than about a week. In another example, the time period can be a function of the time period for virus proliferation in the tumor or metastasis; for example, the time period can be more than the amount of time for a detectable signal to arise in a tumor or metastasis after administration of a virus expressing a detectable marker, such as about 3 days, about 5 days, about a week, about ten days, about two weeks, or about a month.

ii. Therapeutic Compounds

Any therapeutic or anti-cancer agent can be used as the second, therapeutic or anti-cancer agent in the combined cancer treatment methods provided herein. The methods can include administering one or more therapeutic compounds to the subject in addition to administering a virus or plurality thereof to a subject. Therapeutic compounds can act independently, or in conjunction with the virus, for tumor therapeutic effects.

Therapeutic compounds that can act independently include any of a variety of known chemotherapeutic compounds that can inhibit tumor growth, inhibit metastasis growth and/or formation, decrease the size of a tumor or metastasis, eliminate a tumor or metastasis, without reducing the ability of a virus to accumulate in a tumor, replicate in the tumor, and cause or enhance an anti-tumor immune response in the subject.

Therapeutic compounds that act in conjunction with the viruses include, for example, compounds that alter the expression of the viruses or compounds that can interact with a virally-expressed gene, or compounds that can inhibit virus proliferation, including compounds toxic to the virus. Therapeutic compounds that can act in conjunction with the virus include, for example, therapeutic compounds that increase the proliferation, toxicity, tumor cell killing or immune response eliciting properties of a virus, and also can include, for example, therapeutic compounds that decrease the proliferation, toxicity or cell killing properties of a virus. Optionally, the therapeutic agent can exhibit or manifest additional properties, such as, properties that permit its use as an imaging agent, as described elsewhere herein.

Therapeutic compounds also include, but are not limited to, chemotherapeutic agents, nanoparticles, radiation therapy, siRNA molecules, enzyme/pro-drug pairs, photosensitizing agents, toxins, microwaves, a radionuclide, an angiogenesis inhibitor, a mitosis inhibitor protein (e.g., cdc6), an antitumor oligopeptide (e.g., antimitotic oligopeptides, high affinity tumor-selective binding peptides), a signaling modulator, anti-cancer antibiotics, or a combination thereof.

Exemplary photosensitizing agents include, but are not limited to, for example, indocyanine green, toluidine blue, aminolevulinic acid, texaphyrins, benzoporphyrins, phenothiazines, phthalocyanines, porphyrins such as sodium porfimer, chlorins such as tetra(m-hydroxyphenyl)chlorin or tin(IV) chlorin e6, purpurins such as tin ethyl etiopurpurin, purpurinimides, bacteriochlorins, pheophorbides, pyropheophorbides or cationic dyes. In one embodiment, a vaccinia virus, such as a vaccinia virus provided herein, is administered to a subject having a tumor, cancer or metastasis in combination with a photosensitizing agent.

Radionuclides, which depending up the radionuclide, amount and application can be used for diagnosis and/or for treatment. They include, but are not limited to, for example, a compound or molecule containing $^{32}$Phosphate, $^{60}$Cobalt, $^{90}$Yttrium, $^{99}$Technicium, $^{103}$Palladium, $^{106}$Ruthenium, $^{111}$Indium, $^{117}$Lutetium, $^{125}$Iodine, $^{131}$Iodine, $^{137}$Cesium, $^{153}$Samarium, $^{186}$Rhenium, $^{188}$Rhenium, $^{192}$Iridium, $^{198}$Gold, $^{211}$Astatine, $^{212}$Bismuth or $^{213}$Bismuth. In one embodiment, a vaccinia virus, such as a vaccinia virus provided herein, is administered to a subject having a tumor, cancer or metastasis in combination with a radionuclide.

Toxins include, but are not limited to, chemotherapeutic compounds such as, but not limited to, 5-fluorouridine, calicheamicin and maytansine. Signaling modulators include, but are not limited to, for example, inhibitors of macrophage inhibitory factor, toll-like receptor agonists and stat 3 inhibitors. In one embodiment, a vaccinia virus, such as a vaccinia virus provided herein, is administered to a subject having a tumor, cancer or metastasis in combination with a toxin or a signaling modulator.

Combination therapy between chemotherapeutic agents and therapeutic viruses can be effective/curative in situations when single agent treatment is not effective. Chemotherapeutic compounds include, but are not limited to, alkylating agents such as thiotepa and cyclophosphamide; alkyl sulfonates such as busulfan, improsulfan and piposulfan; aziridines such as benzodopa, carboquone, meturedopa and uredopa; ethylenimines and methylamelamines including altretamine, triethylenemelamine, triethylenephosphoramide, triethylenethiophosphaoramide and trimethylolomelamime nitrogen mustards such as chiorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elfornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; polysaccharide-K; razoxane; sizofiran; spirogermanium; tenuazonic acid; triaziquone; 2,2',2''-trichlorotriethylamine; urethan; vindesine; dacarbazine; mannomustine; mitobronitol; mitolactol; pipobroman; gacytosine; cytosine arabinoside; cyclophosphamide; thiotepa; taxoids, e.g., paclitaxel and doxetaxel; chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT11; topoisomerase inhibitor RFS 2000; difluoromethylornithine (DMFO); retinoic acid; esperamicins; capecitabine; sunitinib malate (SUTENT); and pharmaceutically acceptable salts, acids or derivatives of any of the above. Also included are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone and toremifene (FARESTON); and antiandrogens such as flutamide, nilutamide, bicalutamide, leuprolide and goserelin; and pharmaceutically acceptable salts, acids or derivatives of any of the above. Such chemotherapeutic compounds that can be used herein include compounds whose toxicities preclude use of the compound in general systemic chemotherapeutic methods. Chemotherapeutic agents also include new classes of targeted chemotherapeutic agents such as, for example, imatinib (sold by Novartis under the trade name GLEEVEC in the United States), gefitinib (developed by Astra Zeneca under the trade name IRESSA) and erlotinib (TARCEVA). Particular chemotherapeutic agents include, but are not limited to, cisplatin, carboplatin, oxaliplatin, DWA2114R, NK121, IS 3 295, and 254-S vincristine, prednisone, doxorubicin and L-asparaginase; mechloroethamine, vincristine, procarbazine and prednisone (MOPP), cyclophosphamide, vincristine, procarbazine and prednisone (C-MOPP), bleomycin, vinblastine, gemcitabine and 5-flurouracil. Exemplary chemotherapeutic agents are, for example, cisplatin, carboplatin, oxaliplatin, DWA2114R, NK121, IS 3 295, and 254-S. In a non-limiting embodiment, a vaccinia virus, such as a vaccinia virus provided herein, is administered to a subject having a tumor, cancer or metastasis in combination with a platinum coordination complex, such as cisplatin, carboplatin, oxaliplatin, DWA2114R, NK121, IS 3 295, and 254-S. Tumors, cancers and metastasis can be any of those provided herein, and in particular, can be a pancreatic tumor, an ovarian tumor, a lung tumor, a colon tumor, a prostate tumor, a cervical tumor or a breast tumor; exemplary tumors are pancreatic and ovarian tumors. Tumors, cancers and metastasis can be a monotherapy-resistant tumor such as, for example, one that does not respond to therapy with virus alone or anti-cancer agent alone, but that does respond to therapy with a combination of virus and anti-cancer agent. Typically, a therapeutically effective amount of virus is systemically administered to the subject and the virus localizes and accumulates in the tumor. Subsequent to administering the virus, the subject is administered a therapeutically effective amount of an anti-cancer agent, such as cisplatin. In one example, cisplatin is administered once-daily for five consecutive days. One of skill in the art could determine when to administer the anti-cancer agent subsequent to the virus using, for example, in vivo animal models. Using the methods provided herein, administration of a virus and anti-cancer agent, such as cisplatin can cause a reduction in tumor volume, can cause tumor growth to stop or be delayed or can cause the tumor to be eliminated from the subject. The status of tumors, cancers and metastasis following treatment can be monitored using any of the methods provided herein and known in the art.

Exemplary anti-cancer antibiotics include, but are not limited to, anthracyclines such as doxorubicin hydrochloride (adriamycin), idarubicin hydrochloride, daunorubicin hydrochloride, aclarubicin hydrochloride, epirubicin hydrochloride and purarubicin hydrochloride, pleomycins such as pleomycin and peplomycin sulfate, mitomycins such as mitomycin C, actinomycins such as actinomycin D, zinostatinstimalamer and polypeptides such as neocarzinostatin. In one embodiment, a vaccinia virus, such as a vaccinia virus provided herein, is administered to a subject having a tumor, cancer or metastasis in combination with an anti-cancer antibiotic.

In one embodiment, nanoparticles can be designed such that they carry one or more therapeutic agents provided herein. Additionally, nanoparticles can be designed to carry a molecule that targets the nanoparticle to the tumor cells. In one non-limiting example, nanoparticles can be coated with a radionuclide and, optionally, an antibody immunoreactive with a tumor-associated antigen. In one embodiment, a vaccinia virus, such as a vaccinia virus provided herein, is administered to a subject having a tumor, cancer or metastasis in combination with a nanoparticle carrying any of the therapeutic agents provided herein.

Radiation therapy has become a foremost choice of treatment for a majority of cancer patients. The wide use of radiation treatment stems from the ability of gamma-irradiation to induce irreversible damage in targeted cells with the preservation of normal tissue function. Ionizing radiation triggers apoptosis, the intrinsic cellular death machinery in cancer cells, and the activation of apoptosis seems to be the principal mode by which cancer cells die following exposure to ionizing radiation. In one embodiment, a vaccinia virus, such as a vaccinia virus provided herein, is administered to a subject having a tumor, cancer or metastasis in combination with radiation therapy.

Thus, provided herein are methods of administering to a subject one or more therapeutic compounds that can act in conjunction with the virus to increase the proliferation, toxicity, tumor cell killing, or immune response eliciting properties of a virus. Also provided herein are methods of administering to a subject one or more therapeutic compounds that can act in conjunction with the virus to decrease the proliferation, toxicity, or cell killing properties of a virus. Therapeutic compounds to be administered can be any of those provided herein or in the art.

Therapeutic compounds that can act in conjunction with the virus to increase the proliferation, toxicity, tumor cell killing or immune response eliciting properties of a virus are compounds that can alter gene expression, where the altered gene expression can result in an increased killing of tumor cells or an increased anti-tumor immune response in the subject. A gene expression-altering compound can, for example, cause an increase or decrease in expression of one or more viral genes, including endogenous viral genes and/or exogenous viral genes. For example, a gene expression-altering compound can induce or increase transcription of a gene in a virus such as an exogenous gene that can cause cell lysis or cell death, that can provoke an immune response, that can catalyze conversion of a prodrug-like compound, or that can inhibit expression of a tumor cell gene. Any of a wide variety of compounds that can alter gene expression are known in the art, including IPTG and RU486. Exemplary genes whose expression can be up-regulated include proteins and RNA molecules, including toxins, enzymes that can convert a prodrug to an anti-tumor drug, cytokines, transcription regulating proteins, siRNA and ribozymes. In another example, a gene expression-altering compound can inhibit or decrease transcription of a gene in a virus such as a heterologous gene that can reduce viral toxicity or reduces viral proliferation. Any of a variety of compounds that can reduce or inhibit gene expression can be used in the methods provided herein, including siRNA compounds, transcriptional inhibitors or inhibitors of transcriptional activators. Exemplary genes whose expression can be down-regulated include proteins and RNA molecules, including viral proteins or RNA that suppress lysis, nucleotide synthesis or proliferation, and cellular proteins or RNA molecules that suppress cell death, immunoreactivity, lysis, or viral replication.

In another embodiment, therapeutic compounds that can act in conjunction with the virus to increase the proliferation, toxicity, tumor cell killing, or immune response eliciting properties of a virus are compounds that can interact with a virally expressed gene product, and such interaction can result in an increased killing of tumor cells or an increased anti-tumor immune response in the subject. A therapeutic compound that can interact with a virally-expressed gene product can include, for example a prodrug or other compound that has little or no toxicity or other biological activity in its subject-administered form, but after interaction with a virally expressed gene product, the compound can develop a property that results in tumor cell death, including but not limited to, cytotoxicity, ability to induce apoptosis, or ability to trigger an immune response. In one non-limiting example, the virus carries an enzyme into the cancer cells. Once the enzyme is introduced into the cancer cells, an inactive form of a chemotherapy drug (i.e., a prodrug) is administered. When the inactive prodrug reaches the cancer cells, the enzyme converts the prodrug into the active chemotherapy drug, so that it can kill the cancer cell. Thus, the treatment is targeted only to cancer cells and does not affect normal cells. The prodrug can be administered concurrently with, or sequentially to, the virus. A variety of prodrug-like substances are known in the art and an exemplary set of such compounds are disclosed elsewhere herein, where such compounds can include gancyclovir, 5-fluorouracil, 6-methylpurine deoxyriboside, cephalosporin-doxorubicin, 4-[(2-chloroethyl)(2-mesuloxyethyl)amino]benzoyl-L-glutamic acid, acetaminophen, indole-3-acetic acid, CB1954, 7-ethyl-10-[4-(1-piperidino)-1-piperidino]carbonyloxycamptothecin, bis-(2-chloroethyl)amino-4-hydroxyphenyl-aminomethanone 28, 1-chloromethyl-5-hydroxy-1,2-dihyro-3H-benz[e]indole, epirubicin-glucuronide, 5'-deoxy5-fluorouridine, cytosine arabinoside, linamarin, and a nucleoside analogue (e.g., fluorouridine, fluorodeoxyuridine, fluorouridine arabinoside, cytosine arabinoside, adenine arabinoside, guanine arabinoside, hypoxanthine arabinoside, 6-mercaptopurineriboside, theoguanosine riboside, nebularine, 5-iodouridine, 5-iododeoxyuridine, 5-bromodeoxyuridine, 5-vinyldeoxyuridine, 9-[(2-hydroxy)ethoxy]methylguanine (acyclovir), 9-[(2-hydroxy-1-hydroxymethyl)-ethoxy]methylguanine (DHPG), azauridine, azacytidine, azidothymidine, dideoxyadenosine, dideoxycytidine, dideoxyinosine, dideoxyguanosine, dideoxythymidine, 3'-deoxyadenosine, 3'-deoxycytidine, 3'-deoxyinosine, 3'-deoxyguanosine, 3'-deoxythymidine).

In another embodiment, therapeutic compounds that can act in conjunction with the virus to decrease the proliferation, toxicity or cell killing properties of a virus are compounds that can inhibit viral replication, inhibit viral toxins or cause viral death. A therapeutic compound that can inhibit viral replication, inhibit viral toxins, or cause viral death can generally include a compound that can block one or more steps in the viral life cycle, including, but not limited to, compounds that can inhibit viral DNA replication, viral RNA transcription, viral coat protein assembly, outer membrane or polysaccharide assembly. Any of a variety of compounds that can block one or more steps in a viral life cycle are known in the art, including any known antiviral compound (e.g., cidofovir), viral DNA polymerase inhibitors, viral RNA polymerase inhibitors, inhibitors of proteins that regulate viral DNA replication or RNA transcription. In another example, a virus can contain a gene encoding a viral life cycle protein, such as DNA polymerase or RNA polymerase that can be inhibited by a compound that is, optionally, non-toxic to the host organism.

In addition to combination therapy between chemotherapeutic agents and a virus provided herein, other more complex combination therapy strategies could be applied as well. For example, a combination therapy can include chemotherapeutic agents, therapeutic antibodies, and a virus provided herein. Alternatively, another combination therapy can be the combination of radiation, therapeutic antibodies, and a virus provided herein. Therefore, the concept of combination therapy also can be based on the application of a virus provided herein virus along with one or more of the following therapeutic modalities, namely, chemotherapeutic agents, radiation therapy, therapeutic antibodies, hyper- or hypothermia therapy, siRNA, diagnostic/therapeutic bacteria, diagnostic/therapeutic mammalian cells, immunotherapy, and/or targeted toxins (delivered by antibodies, liposomes and nanoparticles).

Effective delivery of each components of the combination therapy is an important aspect of the methods provided herein. In accordance with one aspect, the modes of administration discussed below exploit one of more of the key features: (i) delivery of a virus provided herein to the tumors by a mode of administration effect to achieve highest titer of virus and highest therapeutic effect; (ii) delivery of any other mentioned therapeutic modalities to the tumor by a mode of administration to achieve the optimal therapeutic effect. The dose scheme of the combination therapy administered is such that the combination of the two or more therapeutic modalities is therapeutically effective. Dosages will vary in accordance with such factors as the age, health, sex, size and weight of the patient, the route of administration, the toxicity of the drugs, frequency of treatment and the relative susceptibilities of the cancer to each of the therapeutic modalities.

iii. Immunotherapies and Biological Therapies

Therapeutic compounds also include, but are not limited to, compounds that exert an immunotherapeutic effect, stimulate the immune system, carry a therapeutic compound, or a combination thereof. Optionally, the therapeutic agent can exhibit or manifest additional properties, such as, properties that permit its use as an imaging agent, as described elsewhere herein. Such therapeutic compounds include, but are not limited to, anti-cancer antibodies, radiation therapy, siRNA molecules and compounds that suppress the immune system. Immunotherapy includes for example, immune-stimulating molecules (protein-based or non-protein-based), cells and antibodies. Immunotherapy treatments can include stimulating immune cells to act more effectively or to make the tumor cells or tumor associated antigens recognizable to the immune system (i.e., break tolerance).

Cytokines and growth factors include, but are not limited to, interleukins, such as, for example, interleukin-1, interleukin-2, interleukin-6 and interleukin-12, tumor necrosis factors, such as tumor necrosis factor alpha (TNF-α), interferons such as interferon gamma (IFN-γ), granulocyte macrophage colony stimulating factors (GM-CSF), angiogenins, and tissue factors.

Anti-cancer antibodies include, but are not limited to, Rituximab (RITUXAN), ADEPT, Trastuzumab (HERCEPTIN), Tositumomab (BEXXAR), Cetuximab (ERBITUX), Ibritumomab (90Y-Ibritumomab tiuexetan; ZEVALIN), Alemtuzumab (Campath-1H), Epratuzumab (Lymphocide), Gemtuzumab ozogamicin (MYLOTARG), Bevacimab (AVASTIN), and Edrecolomab (PANOREX).

Thus, provided herein are methods of administering to a subject one or more therapeutic compounds that can act in conjunction with the virus to stimulate or enhance the immune system, thereby enhancing the effect of the virus. Such immunotherapy can be either delivered as a separate therapeutic modality or could be encoded (if the immunotherapy is protein-based) by the administered virus.

Biological therapies are treatments that use natural body substances or drugs made from natural body substances. They can help to treat a cancer and control side effects caused by other cancer treatments such as chemotherapy. Biological therapies are also sometimes called Biological Response Modifiers (BRM's), biologic agents or simply "biologics" because they stimulate the body to respond biologically (or naturally) to cancer. Immunotherapy is treatment using natural substances that the body uses to fight infection and disease. Because it uses natural substances, immunotherapy is also a biological therapy. There are several types of drugs that come under the term biological therapy: these include, for example, monoclonal antibodies (mAbs), cancer vaccines, growth factors for blood cells, cancer growth inhibitors, anti-angiogenic factors, interferon alpha, interleukin-2 (IL-2), gene therapy and BCG vaccine for bladder cancer Monoclonal antibodies (mAbs) are of particular interest for treating cancer because of the specificity of binding to a unique antigen and the ability to produce large quantities in the laboratory for mass distribution. Monoclonal antibodies can be engineered to act in the same way as immune system proteins: that is, to seek out and kill foreign matter in your body, such as viruses. Monoclonal antibodies can be designed to recognize epitopes on the surface of cancer cells. The antibodies target specifically bind to the epitopes and either kill the cancer cells or deliver a therapeutic agent to the cancer cell. Methods of conjugating therapeutic agents to antibodies is well-known in the art. Different antibodies have to be made for different types of cancer; for example, Rituximab recognizes CD20 protein on the outside of non Hodgkin's lymphoma cells; ADEPT is a treatment using antibodies that recognize bowel (colon) cancer; and Trastuzumab (HERCEPTIN) recognizes breast cancer cells that produce too much of the protein HER 2 ("HER 2 positive"). Other antibodies include, for example, Tositumomab (BEXXAR), Cetuximab (ERBITUX), Ibritumomab (90Y-Ibritumomab tiuexetan; ZEVALIN), Alemtuzumab (Campath-1H), Epratuzumab (Lymphocide), Gemtuzumab ozogamicin (MYLOTARG) and Bevacimab (AVASTIN). Thus, the viruses provided herein can be administered concurrently with, or sequentially to, one or more monoclonal antibodies in the treatment of cancer. In one embodiment, additional therapy is administered in the form of one or more of any of the other treatment modalities provided herein.

Rather than attempting to prevent infection, such as is the case with the influenza virus, cancer vaccines help treat the cancer once it has developed. The aim of cancer vaccines is to stimulate the immune response. Cancer vaccines include, for example, antigen vaccines, whole cell vaccines, dendritic cell vaccines, DNA vaccines and anti-idiotype vaccines. Antigen vaccines are vaccines made from tumor-associated antigens in, or produced by, cancer cells. Antigen vaccines stimulate a subject's immune system to attack the cancer. Whole cell vaccines are vaccines that use the whole cancer cell, not just a specific antigen from it, to make the vaccine. The vaccine is made from a subject's own cancer cells, another subject's cancer cells or cancer cells grown in a laboratory. The cells are treated in the laboratory, usually with radiation, so that they can't grow, and are administered to the subject via injection or through an intravenous drip into the bloodstream so they can stimulate the immune system to attack the cancer. One type of whole cell vaccine is a dendritic cell vaccine, which help the immune system to recognize and attack abnormal cells, such as cancer cells. Dendritic cell vaccines are made by growing dendritic cells alongside the cancer cells in the lab. The vaccine is administered to stimulate the immune system to attack the cancer. Anti-idiotype vaccines are vaccines that stimulate the body to make antibodies against cancer cells. Cancer cells make some tumor-associated antigens that the immune system recognizes as foreign. But because cancer cells are similar to non-cancer cells, the immune system can respond weakly. DNA vaccines boost the immune response. DNA vaccines are made from DNA from cancer cells that carry the genes for the tumor-associated antigens. When a DNA vaccine is injected, it enables the cells of the immune system to recognize the tumor-associated antigens, and activates the cells in the immune system (i.e., breaking tolerance). The most promising results from using DNA vaccines are in treating melanoma. Thus, the viruses provided herein can be administered concurrently with, or sequentially to, a whole cell vaccine in the treatment of cancer. In one embodiment, additional therapy is administered in the form of one or more of any of the other treatment modalities provided herein.

Growth factors are natural substances that stimulate the bone marrow to make blood cells. Recombinant technology can be used to generate growth factors which can be administered to a subject to increase the number of white blood cells, red blood cells and stem cells in the blood. Growth factors used in cancer treatment to boost white blood cells include Granulocyte Colony Stimulating Factor (G-CSF) also called filgrastim (NEUPOGEN) or lenograstim (Granocyte) and Granulocyte and Macrophage Colony Stimulating Factor (GM-CSF), also called molgramostim. A growth factor to help treat anemia is erythropoietin (EPO). EPO encourages the body to make more red blood cells, which in turn, increases hemoglobin levels and the levels of oxygen in body tissues. Other growth factors are being developed which can boost platelets. Thus, the viruses provided herein can be administered concurrently with, or sequentially to, a growth factor such as GM-CSF, in the treatment of cancer. In one embodiment, additional therapy is administered in the form of one or more of any of the other treatment modalities provided herein.

Cancer growth inhibitors use cell-signaling molecules which control the growth and multiplication of cells, such as cancer cells. Drugs that block these signaling molecules can stop cancers from growing and dividing. Cancer growth factors include, but are not limited to, tyrosine kinases. Thus, drugs that block tyrosine kinases are tyrosine kinase inhibitors (TKIs). Examples of TKIs include, but are not limited to, Erlotinib (TARCEVA, OSI-774), IRESSA (Gefitinib, ZD 1839) and Imatinib (GLIVEC, STI 571). Another type of growth inhibitor is Bortezomib (VELCADE) for multiple myeloma and for some other cancers. VELCADE is a proteasome inhibitor. Proteasomes are found in all cells and help break down proteins in cells. Interfering with the action of proteosomes causes a build up of proteins in the cell to toxic levels; thereby killing the cancer cells. Cancer cells are more sensitive to VELCADE than normal cells. Thus, the viruses provided herein can be administered concurrently with, or sequentially to, a cancer growth inhibitor, such as VELCADE, in the treatment of cancer. In one embodiment, additional therapy is administered in the form of one or more of any of the other treatment modalities provided herein.

Cancers need a blood supply to expand and grow their own blood vessels as they get bigger. Without its own blood supply, a cancer cannot grow due to lack of nutrients and oxygen. Anti-angiogenic drugs stop tumors from developing their own blood vessels. Examples of these types of drugs include, but are not limited to, Thalidomide, mainly for treating myeloma but also in trials for other types of cancer, and Bevacizumab (AVASTIN), a type of monoclonal antibody that has been investigated for bowel cancer. Thus, the viruses provided herein can be administered concurrently with, or sequentially to, an anti-angiogenic drug in the treatment of cancer. In one embodiment, additional therapy is administered in the form of one or more of any of the other treatment modalities provided herein.

Interferon-alpha (IFN-α) is a natural substance produced in the body, in very small amounts, as part of the immune response. IFN-α is administered as a treatment to boost the immune system and help fight cancers such as renal cell (kidney) cancer, malignant melanoma, multiple myeloma and some types of leukemias. IFN-α works in several ways: it can help to stop cancer cells growing, it can also boost the immune system to help it attack the cancer, and it can affect the blood supply to the cancer cells. Thus, the viruses provided herein can be administered concurrently with, or sequentially to, IFN-α in the treatment of cancer. In one embodiment, additional therapy is administered in the form of one or more of any of the other treatment modalities provided herein.

Administration of IL-2 is a biological therapy drug because it is naturally produced by the immune system. Thus, it is also an immunotherapy. Interleukin 2 is used in treating renal cell (kidney) cancer, and is being tested in clinical trials for several other types of cancers. IL-2 works directly on cancer cells by interfering with cell grow and proliferation; it stimulates the immune system by promoting the growth of killer T cells and other cells that attack cancer cells; and it also stimulates cancer cells to secrete chemoattractants that attract immune system cells. IL-2 is generally administered as a subcutaneous injection just under the skin once daily for 5 days, followed by 2 days rest. The cycle of injections is repeated for 4 weeks followed by a week without treatment. The treatment regiment and the number of cycles administered depends on the type of cancer and how it responds to the treatment. IL-2 can be self-administered or administered by a health professional. Alternatively, IL-2 can be administered intravenously via injection or drip. Thus, the viruses provided herein can be administered concurrently with, or sequentially to, IL-2 in the treatment of cancer. In one embodiment, additional therapy is administered in the form of one or more of any of the other treatment modalities provided herein.

Gene therapy involves treating cancer by blocking abnormal genes in cancer cells, repairing or replacing abnormal genes in cancer cells, encouraging even more genes to become abnormal in cancer cells so that they die or become sensitive to treatment, using viruses to carry treatment-activating enzymes into the cancer cells, or a combination thereof. As a result, cancer cells die due to damage in the cell. Cancer cells develop as a result of several types of mutations in several of their genes. Targeted genes include, but are not limited to, those that encourage the cell to multiply (i.e., oncogenes), genes that stop the cell multiplying (i.e., tumor suppressor genes) and genes that repair other damaged genes. Gene therapy can involve repair of damaged oncogenes or blocking the proteins that the oncogenes produce. The tumor suppressor gene, p53, is damaged in many human cancers. Viruses have been used in to deliver an undamaged p53 gene into cancer cells, and early clinical trials are now in progress looking at treating cancers with modified p53-producing viruses. Gene therapy could be used to replace the damaged DNA repairing genes. In an alternative embodiment, methods of increasing DNA damage within a tumor cell can promote death of the tumor cell or cause increased susceptibility of the tumor cell to other cancer treatments, such as radiotherapy or chemotherapy. Thus, the viruses provided herein can be administered concurrently with, or sequentially to, any of the gene therapy methods provided herein or known in the art in the treatment of cancer. In one embodiment, additional therapy is administered in the form of one or more of any of the other treatment modalities provided herein.

Treatment of early stage bladder cancer is called intravesical treatment, which is mainly used to treat stage T1 bladder cancers that are high grade (grade 3 or G3) or carcinoma in situ of the bladder (also known as Tis or CIS). BCG is a vaccine for tuberculosis (TB), which also has been found to be effective in treating CIS and preventing bladder cancers from recurring. In some cases, BCG vaccines have been used for treating grade 2 early bladder cancer. Because bladder cancer can occur anywhere in the bladder lining, it cannot be removed in the same way as the papillary early bladder cancers. Rather a BCG vaccine is administered using intravesical therapy; that is, first, a catheter (tube) put is inserted into the bladder, followed by intra-catheter administration of a BCG vaccine and/or a chemotherapy. BCG treatment occurs weekly for 6 weeks or more depending on the effect on the bladder cancer. BCG treatment of bladder cancer can be combined with other types of treatments, such as administration of chemotherapy (intravesical), IL-2, treatment with drugs that make cells sensitive to light, vitamins, and photodynamic therapy. Thus, the viruses provided herein can be administered concurrently with, or sequentially to, BCG vaccines in the treatment of cancer. In one embodiment, additional therapy is administered in the form of one or more of any of the other treatment modalities provided herein.

f. State of Subject

In another embodiment, the methods provided herein for administering a virus to a subject can be performed on a subject in any of a variety of states, including an anesthetized subject, an alert subject, a subject with elevated body temperature, a subject with reduced body temperature, or other state of the subject that is known to affect the accumulation of a virus in the tumor. As provided herein, it has been determined that a subject that is anesthetized can have a decreased rate of accumulation of a virus in a tumor relative to a subject that is not anesthetized. Further provided herein, it has been determined that a subject with decreased body temperature can have a decreased rate of accumulation of a virus in a tumor relative to a subject with a normal body temperature.

Accordingly, provided herein are methods of administering a virus to a subject, where the methods can include administering a virus to a subject where the subject is not under anesthesia, such as general anesthesia; for example, the subject can be under local anesthesia, or can be unanesthetized. Also provided herein are methods of administering a virus to a subject, where the methods can include administering a virus to a subject with altered body temperature, where the alteration of the body temperature can influence the ability of the virus to accumulate in a tumor; typically, a decrease in body temperature can decrease the ability of a virus to accumulate in a tumor. Thus, in one exemplary embodiment, a method is provided for administering a virus to a subject, where the method includes elevating the body temperature of the subject to a temperature above normal, and administering a virus to the subject, where the virus can accumulate in the tumor more readily in the subject with higher body temperature relative to the ability of the virus to accumulate in a tumor of a subject with a normal body temperature. In another embodiment, localized elevations in temperature in the area surrounding the tumor can be used to increase the accumulation of the virus in the tumor.

2. Monitoring

The methods provided herein can further include one or more steps of monitoring the subject, monitoring the tumor, and/or monitoring the virus administered to the subject. Any of a variety of monitoring steps can be included in the methods provided herein, including, but not limited to, monitoring tumor size, monitoring anti-(tumor antigen) antibody titer, monitoring the presence and/or size of metastases, monitoring the subject's lymph nodes, monitoring the subject's weight or other health indicators including blood or urine markers, monitoring anti-(viral antigen) antibody titer, monitoring viral expression of a detectable gene product, and directly monitoring viral titer in a tumor, tissue or organ of a subject.

The purpose of the monitoring can be simply for assessing the health state of the subject or the progress of therapeutic treatment of the subject, or can be for determining whether or not further administration of the same or a different virus is warranted, or for determining when or whether or not to administer a compound to the subject where the compound can act to increase the efficacy of the therapeutic method, or the compound can act to decrease the pathogenicity of the virus administered to the subject.

a. Monitoring Viral Gene Expression

In some embodiments, the methods provided herein can include monitoring one or more virally expressed genes. Viruses, such as those provided herein that encode a transporter protein or otherwise known in the art, can express one or more detectable gene products, including but not limited to, detectable proteins. The infected cells/tissue can thus be imaged by one more imaging methods. For example the infected cells can be imaged by administering a labeled transporter substrate that is transported into the infected cell by the expressed transporter protein. The localization of the accumulated transporter protein can detected, thereby imaging the infected tissue. The viruses also can encode one more additional detectable proteins that can be imaged by optical or non-optical imaging methods.

As provided herein, measurement of a detectable gene product expressed by a virus can provide an accurate determination of the level of virus present in the subject. As further provided herein, measurement of the location of the detectable gene product, for example, by imaging methods including, but not limited to, magnetic resonance, fluorescence, and tomographic methods, can determine the localization of the virus in the subject. Accordingly, the methods provided herein that include monitoring a detectable viral gene product can be used to determine the presence or absence of the virus in one or more organs or tissues of a subject, and/or the presence or absence of the virus in a tumor or metastases of a subject. Further, the methods provided herein that include monitoring a detectable viral gene product can be used to determine the titer of virus present in one or more organs, tissues, tumors or metastases. Methods that include monitoring the localization and/or titer of viruses in a subject can be used for determining the pathogenicity of a virus; since viral infection, and particularly the level of infection, of normal tissues and organs can indicate the pathogenicity of the probe, methods of monitoring the localization and/or amount of viruses in a subject can be used to determine the pathogenicity of a virus. Since methods provided herein can be used to monitor the amount of viruses at any particular location in a subject, the methods that include monitoring the localization and/or titer of viruses in a subject can be performed at multiple time points, and, accordingly can determine the rate of viral replication in a subject, including the rate of viral replication in one or more organs or tissues of a subject; accordingly, the methods of monitoring a viral gene product can be used for determining the replication competence of a virus. The methods provided herein also can be used to quantitate the amount of virus present in a variety of organs or tissues, and tumors or metastases, and can thereby indicate the degree of preferential accumulation of the virus in a subject; accordingly, the viral gene product monitoring methods provided herein can be used in methods of determining the ability of a virus to accumulate in tumor or metastases in preference to normal tissues or organs. Since the viruses used in the methods provided herein can accumulate in an entire tumor or can accumulate at multiple sites in a tumor, and can also accumulate in metastases, the methods provided herein for monitoring a viral gene product can be used to determine the size of a tumor or the number of metastases that are present in a subject. Monitoring such presence of viral gene product in tumor or metastasis over a range of time can be used to assess changes in the tumor or metastasis, including growth or shrinking of a tumor, or development of new metastases or disappearance of metastases, and also can be used to determine the rate of growth or shrinking of a tumor, or development of new metastases or disappearance of metastases, or the change in the rate of growth or shrinking of a tumor, or development of new metastases or disappearance of metastases. Accordingly, the methods of monitoring a viral gene product can be used for monitoring a neoplastic disease in a subject, or for determining the efficacy of treatment of a neoplastic disease, by determining rate of growth or shrinking of a tumor, or development of new metastases or disappearance of metastases, or the change in the rate of growth or shrinking of a tumor, or development of new metastases or disappearance of metastases.

Any of a variety of detectable proteins can be detected in the monitoring methods provided herein; an exemplary, non-limiting list of such detectable proteins includes any of a variety of fluorescent proteins (e.g., green or red fluorescent proteins), any of a variety of luciferases, transferrin or other iron binding proteins; or receptors, binding proteins, and antibodies, where a compound that specifically binds the receptor, binding protein or antibody can be a detectable agent or can be labeled with a detectable substance (e.g., a radionuclide or imaging agent). Viruses expressing a detectable protein can be detected by a combination of the method provided herein and know in the art. Viruses expressing more than one detectable protein or two or more viruses expressing various detectable protein can be detected and distinguished by dual imaging methods. For example, a virus expressing a fluorescent protein and an iron binding protein can be detected in vitro or in vivo by low light fluorescence imaging and magnetic resonance, respectively. In another example, a virus expressing two or more fluorescent proteins can be detected by fluorescence imaging at different wavelength. In vivo dual imaging can be performed on a subject that has been administered a virus expressing two or more detectable gene products or two or more viruses each expressing one or more detectable gene products. In a particular example, the viruses such as the hNET encoding viruses provided herein can be imaged by detection of the accumulation of a radiolabeled MIBG substrate that is transported by the hNET transporter into a tumor cell. Such viruses can also be imaged by optical methods such as detection of GFP expression by fluorescence imaging.

b. Monitoring Tumor Size

Also provided herein are methods of monitoring tumor and/or metastasis size and location. Tumor and or metastasis size can be monitored by any of a variety of methods known in the art, including external assessment methods or tomographic or magnetic imaging methods. In addition to the methods known in the art, methods provided herein, for example, monitoring viral gene expression, can be used for monitoring tumor and/or metastasis size.

Monitoring size over several time points can provide information regarding the increase or decrease in size of a tumor or metastasis, and can also provide information regarding the presence of additional tumors and/or metastases in the subject. Monitoring tumor size over several time points can provide information regarding the development of a neoplastic disease in a subject, including the efficacy of treatment of a neoplastic disease in a subject.

c. Monitoring Antibody Titer

The methods provided herein also can include monitoring the antibody titer in a subject, including antibodies produced in response to administration of a virus to a subject. The viruses administered in the methods provided herein can elicit an immune response to endogenous viral antigens. The viruses administered in the methods provided herein also can elicit an immune response to exogenous genes expressed by a virus. The viruses administered in the methods provided herein also can elicit an immune response to tumor antigens. Monitoring antibody titer against viral antigens, viral expressed exogenous gene products, or tumor antigens can be used in methods of monitoring the toxicity of a virus, monitoring the efficacy of treatment methods, or monitoring the level of gene product or antibodies for production and/or harvesting.

In one embodiment, monitoring antibody titer can be used to monitor the toxicity of a virus. Antibody titer against a virus can vary over the time period after administration of the virus to the subject, where at some particular time points, a low anti-(viral antigen) antibody titer can indicate a higher toxicity, while at other time points a high anti-(viral antigen) antibody titer can indicate a higher toxicity. The viruses used in the methods provided herein can be immunogenic, and can, therefore, elicit an immune response soon after administering the virus to the subject. Generally, a virus against which a subject's immune system can quickly mount a strong immune response can be a virus that has low toxicity when the subject's immune system can remove the virus from all normal organs or tissues. Thus, in some embodiments, a high antibody titer against viral antigens soon after administering the virus to a subject can indicate low toxicity of a virus. In contrast, a virus that is not highly immunogenic can infect a host organism without eliciting a strong immune response, which can result in a higher toxicity of the virus to the host. Accordingly, in some embodiments, a high antibody titer against viral antigens soon after administering the virus to a subject can indicate low toxicity of a virus.

In other embodiments, monitoring antibody titer can be used to monitor the efficacy of treatment methods. In the methods provided herein, antibody titer, such as anti-(tumor antigen) antibody titer, can indicate the efficacy of a therapeutic method such as a therapeutic method to treat neoplastic disease. Therapeutic methods provided herein can include causing or enhancing an immune response against a tumor and/or metastasis. Thus, by monitoring the anti-(tumor antigen) antibody titer, it is possible to monitor the efficacy of a therapeutic method in causing or enhancing an immune response against a tumor and/or metastasis. The therapeutic methods provided herein also can include administering to a subject a virus that can accumulate in a tumor and can cause or enhance an anti-tumor immune response. Accordingly, it is possible to monitor the ability of a host to mount an immune response against viruses accumulated in a tumor or metastasis, which can indicate that a subject has also mounted an anti-tumor immune response, or can indicate that a subject is likely to mount an anti-tumor immune response, or can indicate that a subject is capable of mounting an anti-tumor immune response.

In other embodiments, monitoring antibody titer can be used for monitoring the level of gene product or antibodies for production and/or harvesting. As provided herein, methods can be used for producing proteins, RNA molecules or other compounds by expressing an exogenous gene in a virus that has accumulated in a tumor. Further provided herein are methods for producing antibodies against a protein, RNA molecule or other compound produced by exogenous gene expression of a virus that has accumulated in a tumor. Monitoring antibody titer against the protein, RNA molecule or other compound can indicate the level of production of the protein, RNA molecule or other compound by the tumor-accumulated virus, and also can directly indicate the level of antibodies specific for such a protein, RNA molecule or other compound.

d. Monitoring General Health Diagnostics

The methods provided herein also can include methods of monitoring the health of a subject. Some of the methods provided herein are therapeutic methods, including neoplastic disease therapeutic methods. Monitoring the health of a subject can be used to determine the efficacy of the therapeutic method, as is known in the art. The methods provided herein also can include a step of administering to a subject a virus. Monitoring the health of a subject can be used to determine the pathogenicity of a virus administered to a subject. Any of a variety of health diagnostic methods for monitoring disease such as neoplastic disease, infectious disease, or immune-related disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, or reactive protein concentration.

e. Monitoring Coordinated with Treatment

Also provided herein are methods of monitoring a therapy, where therapeutic decisions can be based on the results of the monitoring. Therapeutic methods provided herein can include administering to a subject a virus, where the virus can preferentially accumulate in a tumor and/or metastasis, and where the virus can cause or enhance an anti-tumor immune response. Such therapeutic methods can include a variety of steps including multiple administrations of a particular virus, administration of a second virus, or administration of a therapeutic compound. Determination of the amount, timing or type of virus or compound to administer to the subject can be based on one or more results from monitoring the subject. For example, the antibody titer in a subject can be used to determine whether or not it is desirable to administer a virus or compound, the quantity of virus or compound to administer, and the type of virus or compound to administer, where, for example, a low antibody titer can indicate the desirability of administering additional virus, a different virus, or a therapeutic compound such as a compound that induces viral gene expression. In another example, the overall health state of a subject can be used to determine whether or not it is desirable to administer a virus or compound, the quantity of virus or compound to administer, and the type of virus or compound to administer, where, for example, determining that the subject is healthy can indicate the desirability of administering additional virus, a different virus, or a therapeutic compound such as a compound that induces viral gene expression. In another example, monitoring a detectable virally expressed gene product can be used to determine whether or not it is desirable to administer a virus or compound, the quantity of virus or compound to administer, and the type of virus or compound to administer. Such monitoring methods can be used to determine whether or not the therapeutic method is effective, whether or not the therapeutic method is pathogenic to the subject, whether or not the virus has accumulated in a tumor or metastasis, and whether or not the virus has accumulated in normal tissues or organs. Based on such determinations, the desirability and form of further therapeutic methods can be derived.

In one embodiment, determination of whether or not a therapeutic method is effective can be used to derive further therapeutic methods. Any of a variety of methods of monitoring can be used to determine whether or not a therapeutic method is effective, as provided herein or otherwise known in the art. If monitoring methods indicate that the therapeutic method is effective, a decision can be made to maintain the current course of therapy, which can include further administrations of a virus or compound, or a decision can be made that no further administrations are required. If monitoring methods indicate that the therapeutic method is ineffective, the monitoring results can indicate whether or not a course of treatment should be discontinued (e.g., when a virus is pathogenic to the subject), or changed (e.g., when a virus accumulates in a tumor without harming the host organism, but without eliciting an anti-tumor immune response), or increased in frequency or amount (e.g., when little or no virus accumulates in tumor).

In one example, monitoring can indicate that a virus is pathogenic to a subject. In such instances, a decision can be made to terminate administration of the virus to the subject, to administer lower levels of the virus to the subject, to administer a different virus to a subject, or to administer to a subject a compound that reduces the pathogenicity of the virus. In one example, administration of a virus that is determined to be pathogenic can be terminated. In another example, the dosage amount of a virus that is determined to be pathogenic can be decreased for subsequent administration; in one version of such an example, the subject can be pre-treated with another virus that can increase the ability of the pathogenic virus to accumulate in tumor, prior to re-administering the pathogenic virus to the subject. In another example, a subject can have administered thereto a virus that is pathogenic to the subject; administration of such a pathogenic virus can be accompanied by administration of, for example, an antiviral compound (e.g., cidofovir), pathogenicity attenuating compound (e.g., a compound that down-regulates the expression of a lytic or apoptotic gene product), or other compound that can decrease the proliferation, toxicity, or cell killing properties of a virus, as described herein elsewhere. In one variation of such an example, the localization of the virus can be monitored, and, upon determination that the virus is accumulated in tumor and/or metastases but not in normal tissues or organs, administration of the antiviral compound or pathogenicity attenuating compound can be terminated, and the pathogenic activity of the virus can be activated or increased, but limited to the tumor and/or metastasis. In another variation of such an example, after terminating administration of the antiviral compound or pathogenicity attenuating compound, the presence of the virus and/or pathogenicity of the virus can be further monitored, and administration of such a compound can be reinitiated if the virus is determined to pose a threat to the host by, for example, spreading to normal organs or tissues, releasing a toxin into the vasculature, or otherwise having pathogenic effects reaching beyond the tumor or metastasis.

In another example, monitoring can determine whether or not a virus has accumulated in a tumor or metastasis of a subject. Upon such a determination, a decision can be made to further administer additional virus, a different virus or a compound to the subject. In another example, monitoring the presence of a virus in a tumor can be used in deciding to administer to the subject a compound, where the compound can increase the pathogenicity, proliferation, or immunogenicity of a virus or the compound can otherwise act in conjunction with the virus to increase the proliferation, toxicity, tumor cell killing, or immune response eliciting properties of a virus; in one variation of such an example, the virus can, for example, have little or no lytic or cell killing capability in the absence of such a compound; in a further variation of such an example, monitoring of the presence of the virus in a tumor or metastasis can be coupled with monitoring the absence of the virus in normal tissues or organs, where the compound is administered if the virus is present in tumor or metastasis and not at all present or substantially not present in normal organs or tissues; in a further variation of such an example, the amount of virus in a tumor or metastasis can be monitored, where the compound is administered if the virus is present in tumor or metastasis at sufficient levels.

H. Other Microorganisms and Cells

In some examples, an isolated cell, such as a mammalian cell, can contain any of the viruses provided herein that encode a transporter protein. For example, an isolated cell can be infected with a virus provided herein. Exemplary of such cells are tumor cells, stem cells, immune cells or other cells that can localize in tumor tissues. The virally infected cells also can be administered to patient or subject with a tumor for diagnosis and/or treatment of the tumor.

I. Examples

The following examples are included for illustrative purposes only and are not intended to limit the scope of the invention.

Example 1

Recombinant Viruses Generation

A. Construction of Modified Vaccinia Viruses

Modified vaccinia viruses containing DNA encoding several types of transporter proteins were generated by removing and inserting nucleic acid at several gene loci in a vaccinia virus genome, including F14.5L (also referred to as F3; see U.S. Patent Publication No. 2005/0031643), thymidine kinase (TK; J2R) and/or hemagglutinin (HA; A56R) gene loci. The heterologous DNA inserted into the virus genome included expression cassettes containing protein-encoding DNA operably linked to a vaccinia virus promoter. Modified vaccinia strains encoding the following transporter proteins were generated: Human norepinephrine transporter (hNET) and the human sodium iodide symporter (hNIS). Modified vaccinia viruses containing a transporter gene, hNET, and a anti-cancer therapeutic gene, IL-24, also were generated.

The starting strain for the modified vaccinia viruses described herein was vaccinia virus (VV) strain GLV-1h68 (also named RVGL21, SEQ ID NO: 1). This genetically engineered strain, which has been described in U.S. Patent Publication No. 2005/0031643, contains DNA insertions in the F14.5L, thymidine kinase (TK) and hemagglutinin (HA) genes. GLV-1h68 was prepared from the vaccinia virus strain designated LIVP (a vaccinia virus strain, originally derived by adapting the vaccinia Lister strain (ATCC Catalog No. VR-1549) to calf skin (Research Institute of Viral Preparations, Moscow, Russia, Al'tshtein et al. (1983) *Dokl. Akad. Nauk USSR* 285:696-699). The LIVP strain, whose genome sequence is set forth in SEQ ID NO: 2 and from which GLV-1h68 was generated, contains a mutation in the coding sequence of the TK gene, in which a substitution of a guanine nucleotide with a thymidine nucleotide (nucleotide position 80207 of SEQ ID NO: 2) introduces a premature STOP codon within the coding sequence.

As described in U.S. Patent Publication No. 2005/0031643 (see particularly, Example 1 of the application), GLV-1h68 was generated by inserting expression cassettes encoding detectable marker proteins into the F14.5L (also designated in LIVP as F3) gene, thymidine kinase (TK) gene, and hemagglutinin (HA) gene loci of the vaccinia virus LIVP strain. Specifically, an expression cassette containing a Ruc-GFP cDNA (a fusion of DNA encoding *Renilla* luciferase and DNA encoding GFP) under the control of a vaccinia synthetic early/late promoter $P_{SEL}$ was inserted into the F14.5L gene; an expression cassette containing DNA encoding beta-galactosidase under the control of the vaccinia early/late promoter $P_{7.5k}$ (denoted ($P_{7.5k}$)LacZ) and DNA encoding a rat transferrin receptor positioned in the reverse orientation for transcription relative to the vaccinia synthetic early/late promoter $P_{SEL}$ (denoted ($P_{SEL}$)rTrfR) was inserted into the TK gene (the resulting virus does not express transferrin receptor protein since the DNA encoding the protein is positioned in the reverse orientation for transcription relative to the promoter in the cassette); and an expression cassette containing DNA encoding β-glucuronidase under the control of the vaccinia late promoter $P_{11k}$ (denoted ($P_{11k}$)gusA) was inserted into the HA gene.

Insertion of the expression cassettes into the LIVP genome to generate the GLV-1h68 strain resulted in disruption of the coding sequences for each of the F14.5L, TK and HA genes; accordingly, all three genes in the resulting strains are non-functional in that they do not encode the corresponding full-length proteins. As described in U.S. Patent Publication No. 2005/0031643, disruption of these genes not only attenuates the virus, but also enhances its tumor-specific accumulation. Previous data have shown that systemic delivery of the GLV-1h68 virus in a mouse model of breast cancer resulted in the complete eradication of large subcutaneous GI-101A human breast carcinoma xenograft tumors in nude mice (see U.S. Patent Publication No. 2005/0031643).

1. Modified Viral Strains

Modified recombinant vaccinia viruses containing heterologous DNA inserted into one or more loci of the vaccinia virus genome were generated via homologous recombination between DNA sequences in the genome and a transfer vector using methods described herein and known to those of skill in the art (see, e.g., Falkner and Moss (1990) *J. Virol.* 64:3108-2111; Chakrabarti et al. (1985) *Mol. Cell Biol.* 5:3403-3409; and U.S. Pat. No. 4,722,848). In these methods, the existing target gene in the starting vaccinia virus genome is replaced by an interrupted copy of the gene contained in the transfer vector through two crossover events: a first crossover event of homologous recombination between the vaccinia virus genome and the transfer vector and a second crossover event of homologous recombination between direct repeats within the target locus. The interrupted version of the target gene that is in the transfer vector contains the insertion DNA flanked on each side by DNA corresponding to the left portion of the target gene and right portion of the target gene, respectively. The transfer vector also contains a dominant selection marker, e.g., the *E. coli* guanine phosphoribosyltransferase (gpt) gene, under the control of a vaccinia virus early promoter (e.g., $P_{7.5kE}$). Including such a marker in the vector enables a transient dominant selection process to identify recombinant virus grown under selective pressure that has incorporated the transfer vector within its genome. Because the marker gene is not stably integrated into the genome, it is deleted from the genome in a second crossover event that occurs when selection is removed. Thus, the final recombinant virus contains the interrupted version of the target gene as a disruption of the target loci, but does not retain the selectable marker from the transfer vector.

Homologous recombination between a transfer vector and a starting vaccinia virus genome occurred upon introduction of the transfer vector into cells that have been infected with the starting vaccinia virus. A series of transfer vectors was constructed as described below and the following modified vaccinia strains were constructed: GLV-1h99, GLV-1h100, GLV-1h101, GLV-1h139, GLV-1h146, GLV-1h150, GLV-1h151, GLV-1h152, GLV-1h153. The construction of these strains is summarized in the following Table, which lists the modified vaccinia virus strains, including the previously described GLV-1h68, their respective genotypes, and the transfer vectors used to engineer the viruses:

TABLE 6

Generation of engineered vaccinia viruses

| Name of Virus | Parental Virus | VV Transfer Vector | Genotype |
|---|---|---|---|
| GLV-1h68 | — | — | F14.5L: ($P_{SEL}$)Ruc-GFP<br>TK: ($P_{SEL}$)rTrfR-($P_{7.5k}$)LacZ<br>HA: ($P_{11k}$)gusA |

TABLE 6-continued

Generation of engineered vaccinia viruses

| Name of Virus | Parental Virus | VV Transfer Vector | Genotype |
|---|---|---|---|
| GLV-1h99 | GLV-1h68 | FSE-hNET | F14.5L: ($P_{SE}$)hNET<br>TK: ($P_{SEL}$)rTrfR-($P_{7.5k}$)LacZ<br>HA: ($P_{11k}$)gusA |
| GLV-1h100 | GLV-1h68 | TK-SE-hNET3 | F14.5L: ($P_{SEL}$)Ruc-GFP<br>TK: ($P_{SE}$)hNET<br>HA: ($P_{11k}$)gusA |
| GLV-1h101 | GLV-1h68 | TK-SL-hNET3 | F14.5L: ($P_{SEL}$)Ruc-GFP<br>TK: ($P_{SL}$)hNET<br>HA: ($P_{11k}$)gusA |
| GLV-1h139 | GLV-1h68 | HA-SE-hNET-1 | F14.5L: ($P_{SEL}$)Ruc-GFP<br>TK: ($P_{SEL}$)rTrfR-($P_{7.5k}$)LacZ<br>HA: ($P_{SE}$)hNET |
| GLV-1h146 | GLV-1h100 | HA-SE-IL-24-1 | F14.5L: ($P_{SEL}$)Ruc-GFP<br>TK: ($P_{SE}$)hNET<br>HA: ($P_{SE}$)IL-24 |
| GLV-1h150 | GLV-1h101 | HA-SE-IL-24-1 | F14.5L: ($P_{SEL}$)Ruc-GFP<br>TK: ($P_{SL}$)hNET<br>HA: ($P_{SE}$)IL-24 |
| GLV-1h151 | GLV-1h68 | HA-SE-hNIS-1 | F14.5L: ($P_{SEL}$)Ruc-GFP<br>TK: ($P_{SEL}$)rTrfR-($P_{7.5k}$)LacZ<br>HA: ($P_{SE}$)hNIS |
| GLV-1h152 | GLV-1h68 | HA-SEL-hNIS-2 | F14.5L: ($P_{SEL}$)Ruc-GFP<br>TK: ($P_{SEL}$)rTrfR-($P_{7.5k}$)LacZ<br>HA: ($P_{SEL}$)hNIS |
| GLV-1h153 | GLV-1h68 | HA-SL-hNIS-1 | F14.5L: ($P_{SEL}$)Ruc-GFP<br>TK: ($P_{SEL}$)rTrfR-($P_{7.5k}$)LacZ<br>HA: ($P_{SL}$)hNIS |

Briefly, the strains listed in Table 6 were generated as follows (further details are provided below):

GLV-1h99 was generated by insertion of an expression cassette encoding hNET under the control of the vaccinia $P_{SE}$ promoter into the F14.5L locus of starting strain GLV-1h68, thereby deleting the Ruc-GFP fusion gene expression cassette at the F14.5L locus of starting GLV-1h68. Thus, in strain GLV-1h99, the vaccinia F14.5L gene is interrupted within the coding sequence by a DNA fragment containing DNA encoding hNET operably linked to the vaccinia synthetic early promoter.

GLV-1h100 was generated by insertion of an expression cassette encoding hNET under the control of the vaccinia $P_{SE}$ promoter into the TK locus of starting strain GLV-1h68 thereby deleting the LacZ/rTFr expression cassette at the TK locus of starting GLV-1h68. Thus, in strain GLV-1h100, the vaccinia TK gene is interrupted within the coding sequence by a DNA fragment containing DNA encoding hNET operably linked to the vaccinia synthetic early promoter.

GLV-1h101 was generated by insertion of an expression cassette encoding hNET under the control of the vaccinia $P_{SL}$ promoter into the TK locus of starting strain GLV-1h68 thereby deleting the LacZ/rTFr expression cassette at the TK locus of starting GLV-1h68. Thus, in strain GLV-1h101, the vaccinia TK gene is interrupted within the coding sequence by a DNA fragment containing DNA encoding hNET operably linked to the vaccinia synthetic late promoter.

GLV-1h139 was generated by insertion of an expression cassette encoding hNET under the control of the vaccinia $P_{SE}$ promoter into the HA locus of starting strain GLV-1h68 thereby deleting the gusA expression cassette at the HA locus of starting GLV-1h68. Thus, in strain GLV-1h139, the vaccinia HA gene is interrupted within the coding sequence by a DNA fragment containing DNA encoding hNET operably linked to the vaccinia synthetic early promoter.

GLV-1h146 was generated by insertion of an expression cassette encoding IL-24 under the control of the vaccinia $P_{SE}$ promoter into the HA locus of starting strain GLV-1h100, thereby deleting the gusA expression cassette at the HA locus of starting GLV-1h100. Thus, in strain GLV-1h146, the vaccinia HA gene is interrupted within the coding sequence by a DNA fragment containing DNA encoding IL-24 operably linked to the vaccinia synthetic early promoter and the vaccinia TK gene is interrupted within the coding sequence by a DNA fragment containing DNA encoding hNET operably linked to the vaccinia synthetic early promoter.

GLV-1h150 was generated by insertion of an expression cassette encoding IL-24 under the control of the vaccinia $P_{SE}$ promoter into the HA locus of starting strain GLV-1h101, thereby deleting the gusA expression cassette at the HA locus of starting GLV-1h101. Thus, in strain GLV-1h150, the vaccinia HA gene is interrupted within the coding sequence by a DNA fragment containing DNA encoding IL-24 operably linked to the vaccinia synthetic early promoter and the vaccinia TK gene is interrupted within the coding sequence by a DNA fragment containing DNA encoding hNET operably linked to the vaccinia synthetic late promoter.

GLV-1h151 was generated by insertion of an expression cassette encoding hNIS under the control of the vaccinia $P_{SE}$ promoter into the HA locus of starting strain GLV-1h68 thereby deleting the gusA expression cassette at the HA locus of starting GLV-1h68. Thus, in strain GLV-1h151, the vaccinia HA gene is interrupted within the coding sequence by a DNA fragment containing DNA encoding hNIS operably linked to the vaccinia synthetic early promoter.

GLV-1h152 was generated by insertion of an expression cassette encoding hNIS under the control of the vaccinia $P_{SEL}$ promoter into the HA locus of starting strain GLV-1h68 thereby deleting the gusA expression cassette at the HA locus of starting GLV-1h68. Thus, in strain GLV-1h152, the vaccinia HA gene is interrupted within the coding sequence by a DNA fragment containing DNA encoding hNIS operably linked to the vaccinia synthetic early/late promoter.

GLV-1h153 was generated by insertion of an expression cassette encoding hNIS under the control of the vaccinia $P_{SL}$ promoter into the HA locus of starting strain GLV-1h68 thereby deleting the gusA expression cassette at the HA locus of starting GLV-1h68. Thus, in strain GLV-1h153, the vaccinia HA gene is interrupted within the coding sequence by a DNA fragment containing DNA encoding hNIS operably linked to the vaccinia synthetic late promoter.

2. VV Transfer Vectors Employed for the Production of Modified Vaccinia Viruses

The following vectors were constructed and employed as described below to generate the recombinant vaccinia viral strains.

a. FSE-hNET: For Insertion of an Expression Cassette Encoding hNET Under the Control of the Vaccinia $P_{SE}$ Promoter into the Vaccinia F14.5L Locus The FSE-hNET vector (SEQ ID NO.: 3) was employed to create vaccinia virus strain GLV-1h99, having the following genotype: F14.5L: ($P_{SE}$)hNET, TK: ($P_{SEL}$)rTrfR-($P_{7.5k}$) LacZ, HA: ($P_{11k}$)gusA. FSE-hNET contains the human norepinephrine transporter (hNET) under the control of the vaccinia $P_{SE}$ promoter, flanked by sequences of the F14.5L gene.

To generate the FSE-hNET vector, DNA encoding hNET was PCR amplified from the plasmid pBluescript II KS+-hNET as the template with the following primers:
hNET5 (5'-<u>GTCGAC</u>GCCACCATGCTTCTGGCGCG-GATGAA-3', SEQ ID NO: 4) (Sal I restriction site underlined) and hNET3 (5'-<u>GATATC</u>TCAGATGGCC-AGCCAGTGTT-3', SEQ ID NO: 5) (EcoR V site underlined). The PCR product was gel-purified, and cloned into the pCR-Blunt II-TOPO vector (SEQ ID NO: 6) using the Zero Blunt TOPO PCR Cloning Kit (Invitrogen). The resulting construct pCRII-hNET1 confirmed by sequencing. The hNET cDNA was released from pCRII-hNET1 with Sal I and EcoR V enzyme digest, and subcloned into the intermediate vector pCR-SE1 (SEQ ID NO: 7), precut with SalI and SmaI. This step puts hNET cDNA downstream of the sequence for vaccinia virus synthetic early promoter ($P_{SE}$). The viral hNET expression cassette (SE-hNET) was released from this intermediate construct by BamH I and Hind III enzyme digest, and inserted into the same cut viral transfer vector pNCVVfl4.5T (SEQ ID NO: 8). The final construct FSE-hNET1 was confirmed by sequencing and used for insertion of SE-hNET into the F14.5L locus in GLV-1h68.

b. TK-SE-hNET3: For Insertion of an Expression Cassette Encoding hNET Under the Control of the Vaccinia $P_{SE}$ Promoter into the Vaccinia TK Locus The TK-SE-hNET3 vector (SEQ ID NO.: 9) was employed to create vaccinia virus strain GLV-1h100, having the following genotype: F14.5L: ($P_{SEL}$)Ruc-GFP, TK: ($P_{SE}$)hNET, HA: ($P_{11k}$)gusA. TK-SE-hNET3 contains the human norepinephrine transporter (hNET) under the control of the vaccinia $P_{SE}$ promoter, flanked by sequences of the TK gene. To generate vector TK-SE-hNET3, hNET cDNA was released from FSE-hNET1 with Sal I and Pac I enzyme digestion, and inserted into same cut vector TK-SE-mIP10 (SEQ ID NO: 10). The resulting construct TK-SE-hNET3 was confirmed by sequencing.

c. TK-SL-hNET3: For Insertion of an Expression Cassette Encoding hNET Under the Control of the Vaccinia $P_{SL}$ Promoter into the Vaccinia TK Locus The TK-SL-hNET3 vector (SEQ ID NO.: 11) was employed to create vaccinia virus strain GLV-1h101, having the following genotype: F14.5L: ($P_{SEL}$)Ruc-GFP, TK: ($P_{SL}$)hNET, HA: ($P_{11k}$)gusA. TK-SE-hNET3 contains the human norepinephrine transporter (hNET) under the control of the vaccinia $P_{SL}$ promoter, flanked by sequences of the TK gene. To generate vector TK-SL-hNET3, hNET cDNA was released from FSE-hNET1 with Sal I and Pac I enzyme digestion, and inserted into same cut vector TK-SL-mIP10 (SEQ ID NO: 12). The resulting construct TK-SL-hNET3 was confirmed by sequencing.

d. HA-SE-hNET-1: For Insertion of an Expression Cassette Encoding hNET Under the Control of the Vaccinia $P_{SE}$ Promoter into the Vaccinia HA Locus The HA-SE-hNET-1 vector (SEQ ID NO.: 13) was employed to create vaccinia virus strain GLV-1h139, having the following genotype: F14.5L: ($P_{SEL}$)Ruc-GFP, TK: ($P_{SEL}$)rTrfR-($P_{7.5k}$)LacZ, HA: ($P_{SE}$)hNET. HA-SE-hNET-1 contains the human norepinephrine transporter (hNET) under the control of the vaccinia $P_{SE}$ promoter, flanked by sequences of the HA gene. To generate vector HA-SE-hNET-1, hNET cDNA was released from TK-SL-hNET-3 (SEQ ID NO.: 11) by Sal I and Pac I enzyme digest, and subcloned into same cut vector HA-SE-RLN-7 (SEQ ID NO.: 14), thereby replacing RLN cDNA with the hNET cDNA. The resulting construct HA-SE-hNET-1 was confirmed by sequencing.

e. HA-SE-IL24-1: For Insertion of an Expression Cassette Encoding IL-24 Under the Control of the Vaccinia $P_{SE}$ Promoter into the Vaccinia HA Locus The HA-SE-IL24-1 vector (SEQ ID NO.: 15) was employed to create vaccinia virus strains GLV-1h146 and GLV-1h150, having the following genotypes: F14.5L: ($P_{SEL}$)Ruc-GFP, TK: ($P_{SE}$)hNET, HA: ($P_{SE}$)IL-24 and F14.5L: ($P_{SEL}$)Ruc-GFP, TK: ($P_{SL}$)hNET, HA: ($P_{SE}$)IL-24, respectively. HA-SE-IL24-1 contains the human IL-24 gene under the control of the vaccinia $P_{SE}$ promoter, flanked by sequences of the HA gene. To generate vector HA-SE-IL24-1, human IL24 cDNA was PCR amplified using *Homo sapiens* interleukin 24, transcript variant 1 (cDNA clone MGC: 8926) from Origene as the template with the following primers:
mda-5 (5'-<u>GTCGAC</u>CACCATGAATTTTCAACAGAG-GCTGC-3', SEQ ID NO.: 16) (Sal I site underlined) and
mda-3 (5'-CCC<u>GGG</u>TTATCAGAGCTTGTA-GAATTTCTGCATC-3', SEQ ID NO.: 17) (Sma I site underlined)). The resulting PCR product was gel purified, and cloned into the pCR-Blunt II-TOPO vector (SEQ ID NO.: 6), using Zero Blunt TOPO PCR Cloning Kit (Invitrogen). The resulting construct pCRII-IL24-3 was sequence confirmed. The IL24 cDNA was released from pCRII-IL24-3 by Sal I and Sma I digest, and subcloned into same cut vector pCR-SE1 (SEQ ID NO.: 7), placing IL24 under the control of vaccinia synthetic promoter ($P_{SE}$). The resulting construct pCR-SE-IL24-2 was sequence confirmed. The IL24 was then released by Sal I and Pac I enzyme digest, and subcloned into same cut vector HA-SE-RLN-7 (SEQ ID NO.: 14) thereby replacing RLN cDNA with IL-24 cDNA. The resulting constructs HA-SE-IL24-1 was sequence confirmed.

f. HA-SE-hNIS-1: For Insertion of an Expression Cassette Encoding hNIS Under the Control of the Vaccinia $P_{SE}$ Promoter into the Vaccinia HA Locus The HA-SE-hNIS-1 vector (SEQ ID NO.: 18) was employed to create vaccinia virus strain GLV-1h151, having the following genotype: F14.5L: ($P_{SEL}$)Ruc-GFP, TK: ($P_{SEL}$)rTrfR-($P_{7.5k}$)LacZ, HA: ($P_{SE}$)hNIS. HA-SE-hNIS-1 contains the human sodium iodide symporter (hNIS) under the control of the vaccinia $P_{SE}$ promoter, flanked by sequences of the HA gene. To generate vector HA-SE-hNIS-1, hNIS cDNA was PCR amplified using human cDNA clone TC124097 (SLC5A5) from OriGene as the template with following primers:
hNIS-5 (5'-<u>GTCGAC</u>CACCATGGAGGCCGTGGAGAC-CGG-3', SEQ ID NO.: 19) (Sal I site underlined) and
hNIS-3 (5'-<u>TTAATTAA</u>TCAGAGGTTTGTCTCCTGCTG-GTCTCGA-3', SEQ ID NO.: 20) (Pac I site underlined).

The PCR product was gel-purified, and cloned into the pCR-Blunt II-TOPO vector (SEQ ID NO.: 6) using Zero Blunt TOPO PCR Cloning Kit (Invitrogen). The resulting construct pCRII-hNIS-2 confirmed by sequencing. The hNIS cDNA was released from pCRII-hNIS-2 with Sal I and Pac I enzyme digestion, and subcloned into same cut vector HA-SE-RLN-7 (SEQ ID NO.: 14), thereby replacing RLN cDNA. The resulting construct HA-SE-hNIS-1 was confirmed by sequencing.

g. HA-SEL-hNIS-2: For Insertion of an Expression Cassette Encoding hNIS Under the Control of the Vaccinia $P_{SEL}$ Promoter into the Vaccinia HA Locus The HA-SEL-hNIS-2 vector (SEQ ID NO.: 21) was employed to create vaccinia virus strain GLV-1h152, having the following genotype: F14.5L: ($P_{SEL}$)Ruc-GFP, TK: ($P_{SEL}$)rTrfR-($P_{7.5k}$)LacZ, HA: ($P_{SEL}$)hNIS. HA-SEL-hNIS-2 contains the human sodium iodide symporter (hNIS) under the control of the vaccinia $P_{SEL}$ promoter, flanked by sequences of the HA gene. To generate vector HA-SEL-hNIS-2, the hNIS cDNA was released from pCRII-hNIS-2 with Sal I and Pac I enzyme digestion, and subcloned into same cut vector HA-SEL-RLN-2 (SEQ ID NO.: 22), thereby replacing RLN cDNA. The resulting construct HA-SEL-hNIS-2 was confirmed by sequencing.

h. HA-SL-hNIS-1: For Insertion of an Expression Cassette Encoding hNIS Under the Control of the Vaccinia $P_{SL}$ Promoter into the Vaccinia HA Locus The HA-SL-hNIS-1 vector (SEQ ID NO.: 23) was employed to create vaccinia virus strain GLV-1h153, having the following genotype: F14.5L: ($P_{SEL}$)Ruc-GFP, TK: ($P_{SEL}$) rTrfR-($P_{7.5k}$)LacZ, HA: ($P_{SL}$)hNIS. HA-SL-hNIS-1 contains the human sodium iodide symporter (hNIS) under the control of the vaccinia $P_{SL}$ promoter, flanked by sequences of the HA gene. To generate vector HA-SL-hNIS-1, the hNIS cDNA was released from pCRII-hNIS-2 with Sal I and Pac I enzyme digestion, and subcloned into same cut vector HA-SL-RLN-3 (SEQ ID NO.: 24), thereby replacing RLN cDNA. The resulting construct HA-SL-hNIS-1 was confirmed by sequencing.

3. Preparation of Recombinant Vaccinia Viruses

African green monkey kidney fibroblast CV-1 cells (American Type Culture Collection (Manassas, Va.); CCL-70) were employed for viral generation and production. The cells were grown in Dulbecco's modified Eagle's medium (DMEM) supplemented with 1% antibiotic-antimycotic solution (Mediatech, Inc., Herndon, Va.) and 10% fetal bovine serum (FBS; Mediatech, Inc., Herndon, Va.) at 37° C. under 5% $CO_2$. For virus generation of recombinant viruses, the CV-1 cells were infected with GLV-1h68 (or designated parental virus, see Table 2) at m.o.i. of 0.1 for 1 hr. The infected cells were then transfected using Fugene (Roche, Indianapolis, Ind.) with the designated transfer vector (see Table 2 and description of viral transfer vectors above). At two days post infection, infected/transfected cells were harvested and the recombinant viruses were selected and plaque purified using standard methods as described previously (Falkner and Moss (1990) *J. Virol.* 64:3108-3111).

4. Verification of Vaccinia Virus Strain Genotypes

The genotype of the vaccinia viruses was verified by PCR and restriction enzyme digestion. The lack of expression of gusA gene in viruses GLV-1h139, GLV-1h146, GLV-1h150, GLV-1h151, GLV-1h152 and GLV-1h153 was confirmed X-GlcA (5-bromo-4-chloro-3-indolyl-β-D-glucuronic acid) staining of the infected cells. Viruses lacking gusA expression are unable to convert the X-GlcA substrate as indicated by lack of development of blue color in the assay as compared to a control strain (e.g. GLV-1h68). Lack of expression of the GFP gene in GLV-1h99 was confirmed by fluorescence microscopy as compared to a control strain (e.g. GLV-1h68). The lack of expression of the LacZ gene for viruses GLV-1h100, GLV-1h101, GLV-1h146 and GLV-1h150 was confirmed by X-gal (5-bromo-4-chloro-3-indolyl-β-D-galactopyranoside) staining of the infected cells. Viruses lacking lacZ expression are unable to convert the X-gal substrate as indicated by lack of development of blue color in the assay as compared to a control strain (e.g. GLV-1h68). Standard techniques for X-GlcA and X-gal viral staining and fluorescence microscopy were employed and are well-known in the art.

B. Vaccinia Virus Purification

Ten T225 flasks of confluent CV-1 cells (seeded at $2 \times 10^7$ cells per flask the day before infection) were infected with each virus at m.o.i. of 0.1. The infected cells were harvested two days post infection and lysed using a glass Dounce homogenizer. The cell lysate was clarified by centrifugation at 1,800 g for 5 min, and then layered on a cushion of 36% sucrose, and centrifuged at 13,000 rpm in a HB-6 rotor, Sorvall RC-5B Refrigerated Superspeed Centrifuge for 2 hours. The virus pellet was resuspended in 1 ml of 1 mM Tris, pH 9.0, loaded on a sterile 24% to 40% continuous sucrose gradient, and centrifuged at 26,000 g for 50 min. The virus band was collected and diluted using 2 volumes of 1 mM Tris, pH 9.0, and then centrifuged at 13,000 rpm in a HB-6 rotor for 60 min. The final virus pellet was resuspended in 1 ml of 1 mM Tris, pH 9.0 and the titer was determined in CV-1 cells (ATCC No. CCL-70).

Example 2

In Vitro Virus Infection Studies with GLV-1h99

A. Analysis of Vaccinia Virus Replication in Tissue Culture

To evaluate any effects of hNET expression on vaccinia virus replication, PANC-1 cells were infected with either GLV-1h99 or its parent virus, GLV-1h68, at moi of 0.01 for 1 h at 37° C. The inoculum was then aspirated, and the cell monolayers were washed twice with 2 ml of DPBS (Mediatech, Inc., Herndon, Va.). Two milliliters of cell culture medium containing 2% FBS were added into each well of a multiwell plate. Three wells each were harvested at 24, 48, and 72 hours post infection. The harvested cells were subject to three cycles of freeze-thaw and were sonicated three times for 1 minute at full power before titration. The viral titers at each time point were determined in CV-1 cells using a standard plaque assay.

GLV-1h99 gave significantly higher viral yields (approximately 10 fold) at all three time points in comparison with its parental virus, GLV-1h68. The enhanced viral replication for GLV-1h99 may be due to the difference in the strength of the vaccinia viral promoter at the F14.5L locus in the viruses. GLV-1h68 contains a strong vaccinia $P_{SEL}$ promoter, which is 100 times stronger than a $P_{SE}$ promoter (Chakrabarti et al. (1997) *Biotechniques* 23(6):1094-7). Previous studies have shown that virus replication in cell culture is inversely proportional with strength of promoters inserted into the viral genome. Thus, the use of a $P_{SE}$ promoter in the GLV-1h99 can result in the higher viral titers observed.

(The PANC-1 cells used in the study were obtained from the American Type Culture Collection (Manassas, Va.) and maintained in Dulbecco's modified Eagle's medium (DMEM) supplemented with 1% antibiotic-antimycotic solution (Mediatech, Inc., Herndon, Va.) and 10% fetal bovine serum (FBS; Mediatech, Inc., Herndon, Va.) at 37° C. under 5% $CO_2$).

B. Cytotoxicity Assay

Mesothelioma (MSTO-211H, H2373, JMN and H2052) and pancreatic cancer (PANC-1, MiaPaCa2, BxPC3 and HS766T) cell lines were plated at $2 \times 10^4$ per well in 12-well plates in 1 ml of media per well. After incubation for 6 hours, cells were infected with GLV-1h99 or GLV-1h68 at MOI's (multiplicity of infection) of 1.0, 0.10, and 0.01 and 0 (control wells). Viral cytotoxicity was measured daily for 7 days. Cells were washed with PBS and lysed in 200 μl per well of 1.5% Triton X (Sigma, St. Louis, Mo.) to release intracellular lactate dehydrogenase, which was quantified with a Cytotox 96 kit (Promega, Madison, Wis.) on a spectrophotometer (EL321e, Bio-Tek Instruments) at 490 nm. Results were measured as the percentage of surviving cells. This percentage was determined by comparing the measured lactate dehydrogenase of each infected sample to that in uninfected, control cells. All samples were analyzed in triplicate. Four mesothelioma and four pancreatic cancer cell lines demonstrated lytic cytotoxicity following exposure to GLV-1h99 (hNET-expressing virus) and to GLV-1h68 (non-hNET containing virus). Similar cytotoxicity was observed with GLV-1h99 and GLV-1h68 at a MOI of 1.0 and a dose-dependent lytic effect was also demonstrated for m.o.i. ranging from 0.01 to 1.00. At a MOI of 0.1, all MSTO-211H and H2052 mesothelioma cells as well as 80% of the PANC1 pancreatic cancer cells were dead at day 7. Oncolysis appeared to be more gradual over time in PANC1 cells, compared to the more sigmoidal lytic-time profile in MSTO-211H cells. The mesothelioma cell line JMN and the pancreatic cancer cell line HS766T were more resistant to cell death (80% cell death by day 7 at a MOI of 1.0). MiaPaCa2 and BxPC3 (pancreatic cancer cell lines) and H2373 (mesothelioma cell line) were sensitive to the virus at a higher MOI of 10.

C. Immunoblot Analysis of hNET Expression

To evaluate the level of hNET protein expression in cells CV-1 cells in 60 mm dishes were infected with GLV-1h68 or GLV-1h99 at m.o.i of approximately 10. Approximately two days post infection, cells were harvested and solubilized in RIPA buffer (10 mM Tris, pH 7.4, 150 mM NaCl, 1 mM EDTA, 0.1% SDS, 1% Triton X-100, 1% sodium deoxycholate and proteinase inhibitor cocktail). The cell lysates were separated on a 4-12% Bis-Tris Gel (Invitrogen), and proteins were transferred onto a PVDF membrane (Amersham Biosciences). The membrane was incubated with an anti-hNET monoclonal antibody (NET17-1, Mab Technologies, Stone Mountain, Calif.) at a dilution of approximately 1:500, and detected using WesternBreeze Chromogenic Western Blot Immunodetection Kit (Invitrogen). GLV-1h99-infected cells expressed hNET protein, whereas cells either mock-infected or infected with GLV-1h68 did not. Five major bands (35, 47, 50, 65, 73 kDa) were detected in GLV-1h99-infected CV-1 cells.

In a separate experiment, the two most sensitive mesothelioma cell lines (MSTO-211H and H2052) and the most sensitive pancreatic cancer cell line (PANC1), based on the cytotoxicity assays, were chosen for immunoblot analysis and compared to the endogenous hNET-expressing neuroblastoma cell line, SK-N-SH. hNET protein expression was evaluated in cells infected with either GLV-1h99 or GLV-1h68 viruses at a MOI of 1.0 at 12, 24, 48 and 72 h after infection. A purified mouse antibody against hNET (NET17-1, Mab Tech Inc. GA, USA) was used at a final dilution of 1:500 and incubated for 12 hours at +4° C. The secondary antibody (peroxidase conjugated anti-mouse IgG (Vector labs Inc., CA, USA)) exposure was for 1 hour at a 1:2000 dilution. Peroxidase-bound protein bands were visualized using the ECL method (Amersham Pharmacia Biotech, Little Chalfont, UK).

In addition to the ~80-kD hNET band, two low-molecular weight immunoreactive bands (~50-55 kD and ~37-40 kD, respectively) are seen in the blots of the GLV-1h99-infected cells; these bands are barely visible in the blots of the SK-N-SH neuroblastoma cells. Similar to the cytotoxicity assay, there was a viral dose-dependent expression of hNET at different MOI's (0.1, 1.0, 5 and 10). Strong hNET expression was found in all the three cell lines by 12 hours after GLV-1h99 viral infection, peaking at 24 hours followed by a gradual decline over 72 hours. A similar pattern of hNET expression was observed in the other cell lines, although the hNET immunoblot bands were less intense. The neuroblastoma cell line (SK-N-SH), expressing endogenous hNET, served as a positive control for the immunoblot analysis and radiotracer uptake studies; the GLV-1h68 virus-infected (non-hNET containing virus) and the uninfected mesothelioma and pancreatic cancer cell lines served as negative controls, showing no hNET expression.

D. In Vitro Radiotracer Uptake Assay

[$^{123}$I]MIBG radiotracer uptake studies were performed in MSTO-211h and PANC1 cells after infection with virus (GLV-1h99 or GLV-1h68) at a MOI of 1.0 as well as in the neuroblastoma cell line, SK-N-SH, using previously described methods (Che J et al. (2005) *Mol Imaging* 4:128-36. For these studies, clinical grade [$^{123}$I]MIBG was obtained from MDS Nordion (Canada). The average radiochemical purity was in excess of 97% (determined by MDS Nordion using the Sep Pak cartridge method), and the specific activity ~320 MBq/μmol (8.7 mCi/μmol) according to the vendor. [$^{124}$I]MIBG was prepared using minor modifications to the reported nucleophilic isotopic exchange method (Eersels J et al. (2005) *J Labelled Compds Radiopharm* 48:241-57), following a procedure previously reported (Moroz M A, et al. (2007) *J Nucl Med* 48:827-36). The radiochemical purity of the final product was >95% with an overall yield of >80% and the specific activity 18.5±5.2 MBq/μmol (0.5±0.14 mCi/μmol). The maximum specific activities (no carrier-added synthesis) for the [$^{123}$I]- and [$^{124}$I]-labeled compounds were 8.9 and 1.2 TBq/μmol (241 and 33 Ci/μmol), respectively, due to the 7.4-fold difference in the decay rate of the two isotopes.

For the uptake assay, cells were plated at $1 \times 10^6$ per well in 6-well plates in 2 ml of media per well. After incubation for 6 hours, cells were infected with GLV-1h68 or GLV1h99 at MOIs of 1.0 and 0 (control wells). Following 12-, 24-, 48- and 72-h incubation periods with virus at 37° C. and 5% $CO_2$, the medium was aspirated and the cells were washed with PBS (pH 7.4). [$^{123}$I]MIBG uptake was initiated by adding 2 ml of DME containing 0.0185 MBq/ml (0.5 μCi/ml) carrier-free [$^{123}$I]MIBG. Cells were harvested after a 60-minute incubation period, and the cell pellet-to-medium activity ratio (cpm/gm of pellet/cpm/ml of medium) was calculated from the radioactivity measurements assayed in a gamma counter (Packard, United Technologies). All studies were performed in triplicate. A two-tailed unpaired t-test was applied to determine the significance of differences between values using the MS Office 2003 Excel 11.0 statistical package (Microsoft, Redmond, Wash., USA).

[$^{123}$I]MIBG accumulation in non-infected MSTO-211H and PANC1 cells was low. There was no significant increase in radiotracer uptake 24 h after infection of the cells with GLV-1h68 (non-hNET containing virus, negative control). In contrast, there was a significant ($p<0.01$) increase in [$^{123}$I]MIBG accumulation in both cancer cell lines at all time points (12 h, 24 h, 48 h and 72 h) after infection with GLV-1h99. Peak radiotracer uptake was observed at 48 h after virus infection in both cell lines. The natural hNET-expressing neuroblastoma cell line (SK-N-SH) served as a positive control. Total cell protein in the [$^{123}$I]MIBG uptake assays were unchanged over the first 24 hours following GLV-1h99 infection, compared to uninfected cells. At 48 and 72 h after viral infection, there was a decrease in measured cell protein.

Example 3

In Vivo Animal Model Studies of [$^{123}$I]MIBG Uptake by GLV-1h99 Infected Tumor Cells A. Malignant Pleural Mesothelioma Xenograft Model Athymic nu/nu female mice were purchased from the National Cancer Institute (NCI, MD) and were housed five per cage and allowed food and water ad libitum in the MSKCC Vivarium for 1 week before tumor cell implantation. All animal studies were performed in compliance with all applicable policies, procedures and regulatory requirements of the Institutional Animal Care and Use Committee (IACUC), the Research Animal Resource Center (RARC) of MSKCC and the National Institutes of Health (NIH) "Guide for the Care and Use of Laboratory Animals". All animal procedures were performed under anesthesia induced by inhalation of 2% isoflurane. After the studies all animals were sacrificed by $CO_2$ asphyxiation.

An incision 3 to 5 mm in length was made over the fourth to fifth intercostal space of the right chest. The underlying inflating and deflating lung was thereby easily visualized through the thin fascia. Slowly, 100 μl of MSTO-211H malignant mesothelioma cellular suspension ($5 \times 10^6$ cells) were injected. After the injection the skin was closed with surgical staples and mice were returned to their cages.

Intrapleural treatment with virus was performed in a similar fashion as described above 10 days after tumor cell instillation into the pleural cavity. GLV-1h99 or GLV-1h68 ($1 \times 10^7$ pfu) was administered in 100 μL PBS and animals were gently rotated from side to side to help distribute the virus throughout the pleural cavity. Control animals (no virus) received only 100 μL PBS.

B. [$^{123}$I]MIBG Gamma-Camera in Vivo Imaging

Each animal was injected intravenously with ~18.5 MBq (500 μCi) of [$^{123}$I]MIBG 48 or 72 hours after intrapleural GLV-1h99 injection. Sequential PET imaging was performed 1 to 48 hours after radiotracer administration using a X-SPECT™ dedicated small-animal gamma camera SPECT-CT scanner (Gamma Medica, Northridge, Calif.). A photopeak energy window of 143-175 keV and a low-energy high-resolution (LEHR) parallel-hole collimator was used to acquire ten-minute $^{123}$I images at 2 hours post-[$^{123}$I]MIBG administration.

The X-SPECT™ gamma camera system was calibrated by imaging a mouse-size (30-ml) cylinder filled with an independently measured concentration (MBq/ml) of technetium-99m using a photopeak energy window of 126-154 keV and LEHR collimation. The resulting $^{99m}$Tc images were exported to Intefile and then imported into the ASIPro™ (Siemens Pre-clinical Solutions, Knoxville, Tenn.) image-processing software environment. By region of interest (ROI) analysis, a system calibration factor (in cpm/pixel per MBq/ml) was derived. Animal images were likewise exported to Interfile and then imported into ASIPro™ and parameterized in terms of the decay-corrected percent injected dose per gram (% ID/gm) based on the foregoing calibration factor, the administered activity, the time post-administration of imaging, and the image duration. Implicit in the foregoing analysis is the reasonable assumption that the sensitivities of the X-SPECT™ gamma camera system for $^{123}$I and $^{99m}$Tc are comparable.

C. [$^{124}$I]MIBG microPET in Vivo Imaging

In a group of 5 animals (10 days after MSTO-211H tumor cell instillation into the pleural cavity), each animal was injected via the tail vein with 9.25 MBq (250 μCi) of [$^{18}$F]FDG. (Clinical grade [$^{18}$F]FDG was obtained from IBA Molecular (Somerset, N.J.) with a specific activity>41 MBq/μmol (>11 mCi/μmol) and a radiochemical purity of >98%). [$^{18}$F]FDG PET scanning was performed 1 h after tracer administration using a 10-minute list-mode acquisition. Animals were fasted 12 h before tracer administration and kept under anesthesia between FDG injection and imaging.

In a group of 16 animals, 4 sub-groups of 3-5 animals each were studied (5 animals in sub-group 1 and 2; 3 animals in sub-group 3 and 4). Each animal was injected via the tail vein with 9.25 MBq (250 μCi) of [$^{124}$I]MIBG. Animals in sub-groups 1 and 2 were injected with GLV-1h99 48 and 72 h prior to [$^{124}$I]MIBG administration. Sub-group 3 animals received GLV-1h68 48 h prior to radiotracer administration; sub-group 4 animals was not injected with virus, receiving only 100 μl PBS). Potassium iodide was used to block the uptake of radioactive iodine by the thyroid. [$^{124}$I]MIBG PET was performed for 10 minute 1, 2, and 4 h after tracer administration, for 15 minute at 12 h, for 30 minute at 24 h, and for 60 minute at 48 h. After tracer administration and between imaging time points, the animals were allowed to wake up and maintain normal husbandry.

Imaging was performed using a Focus 120 microPET™ dedicated small-animal PET scanner (Concorde Microsystems Inc, Knoxville, Tenn.). Three-dimensional (3D) list-mode data were acquired using an energy window of 350-700 keV for $^{18}$F and 410-580 keV for $^{124}$I, respectively, and a coincidence timing window of 6 ns. These data were then sorted into two-dimensional (2D) histograms by Fourier re-binning. The image data were corrected for (a) non-uniformity of scanner response using a uniform cylinder source-based normalization, (b) dead time count losses using a singles count rate-based global correction, (c) physical decay to the time of injection, and (d) the $^{124}$I branching ratio. The count rates in the reconstructed images were converted to activity concentration (% of injected dose per gram of tissue, % ID/g) using a system calibration factor (MBq/ml per cps/voxel) derived from imaging of a mouse-size phantom filled with a uniform aqueous solution of $^{18}$F.

Image analysis was performed using ASIPro™ (Siemens Pre-clinical Solutions, Knoxville, Tenn.). ROI's were manually drawn over tumor, lung, liver and skeletal muscle. For each tissue and time point post-injection, the measured radioactivity was expressed as % ID/g. The maximum value was recorded for each tissue and tumor-to-organ ratios for lung, liver and skeletal muscle were then calculated. A two-tailed unpaired t-test was applied to determine the significance of differences between values using the MS Office 2003 Excel 11.0 statistical package (Microsoft, Redmond, Wash., USA).

D. In Vivo Imaging Results

Tumor radioactivity values (% ID/g) were measured and tumor-to-organ ratios were calculated. The highest levels of radioactivity in the pleural tumors were found 48 h after injection of GLV-1h99 (hNET-expressing virus), followed by tumors that were injected with GLV-1h99 72 h prior to [$^{124}$I]MIBG administration. Low levels of radioactivity were observed in tumors that were injected with GLV-1h68 (non-hNET containing virus) and in tumors that were not injected with virus. Maximum activity in both the pleural tumors and remote organs (background) were observed at the time of the initial measurement, 1 hour after radiotracer administration. Tumor and remote organ activity decreased over time (1 to 72 hours) in all four groups of animals. The decrease in tumor activity was more rapid over the first 12 hours after [$^{124}$I]MIBG administration in the two control groups; tumors injected with GLV-1h68 (non-hNET containing virus) or no virus.

Tumor-to-organ (lung, liver, muscle) ratios were calculated from the PET image data and the highest values were obtained for the group of animals that were infected with GLV-1h99 (hNET-expressing virus) 48 h before radiotracer administration. Comparing the animals that were treated with GLV-1h99 48 h before [$^{124}$I]MIBG administration to the animals that received no virus, the ratio differences were highly significant ($p<0.01$) at the 2 h imaging time point and significant ($p<0.05$) at the 1 h imaging time point. Nearly the same low tumor-to-organ ratios were found for the two control groups of animals and the tumor-to-organ ratios decreased over time.

For localization of the tumors and for comparison to a clinically used imaging technique, [$^{18}$F]FDG PET imaging was also performed. [$^{124}$I]MIBG PET and [$^{18}$F]FDG PET imaging were compared. The pleural tumors were visualized by [$^{18}$F]FDG PET imaging, but image contrast at 48 and 72 hours after GLV-1h99 virus (hNET-expressing virus) injection was greater with [$^{124}$I]MIBG PET compared to [$^{18}$F]FDG PET. The [$^{124}$I]MIBG and [$^{18}$F]FDG tumor-to-lung, tumor-to-liver and tumor-to-muscle ratios in control animals were similar.

In vivo hNET expression in the pleural tumors after GLV-1h99 (hNET-expressing) virus administration was also imaged by [$^{123}$I]MIBG planar scintigraphy as described above. All GLV-1h99 injected animals showed localized accumulation of [$^{123}$I]MIBG radioactivity in the virus-injected pleural tumors compared to the control animals that received no virus. The tumor-to-background ratios for the GLV-1h99 infected animals was with 2.4±0.2, significantly ($p<0.01$) higher compared to the group that received no virus, 1.5±0.1.

E. Immunohistochemistry

After each final image was taken, the animals were sacrificed and the tumors harvested and frozen in Tissue-Tek Optimal Cutting Temperature (O.C.T.) Compound (Sakura Finetek USA, Inc., Torrance, Calif.). Tissues were cut into 5-μm thick sections and mounted on glass slides. Cryosections were fixed and stained with hematoxylin and eosin (H & E) and 5-bromo-4-chloro-3-indolyl-B-D-galactopyranoside (X-gal; 1 mg/ml) in an iron solution of 5 mmol/l $K_4Fe(CN)_6$, 5 mmol/l $K_3Fe(CN)_6$, and 2 mmol/l $MgCl_2$, as previously described (Kelly K, et al. (2008) *FASEB J* 22:1839-48), to identify virally mediated lacZ expression.

All pleural lesions were shown to be malignant pleural mesothelioma on H & E staining. In addition, all tumors infected with vaccinia virus stained positive for lacZ, confirming the presence of the virus in tumors and indicating that all tumors visualized by [$^{124}$I]MIBG PET or [$^{123}$I]MIBG scintigraphy reflected GLV-1h99 expression of a functional hNET transporter protein.

Example 4

Effect of an hNET-Expressing Virus on Tumor Growth in Vivo

The hNET expressing virus, GLV-1h99, is derived from the parental virus strain GLV-1h68, which can eradicate solid human breast tumors in nude mice with a single intravenous (i.v.) injection (see U.S. Patent Publication 2005/0031643). The effect of replacing the Ruc-GFP expression cassette at the F14.5L gene locus in GLV-1h68 with hNET expression cassette on the anti-tumor properties of the virus were examined. A mouse xenograft model of human pancreatic cancer was employed for the study.

PANC-1 xenograft tumors were developed in 6-8 weeks old male nude mice (NCI:Hsd:Athymic Nude-Foxnl$^{nu}$, Harlan) by implanting 5×10$^6$ PANC-1 cells subcutaneously on the right hind leg. Tumor growth was recorded once a week in three dimensions using a digital caliper. Tumor volume was calculated as [(length×width×height)/2] and reported in mm$^3$. Twenty-seven days after tumor cell implantation, groups of 8 mice were injected with a single i.v. dose of 5×10$^6$ pfu of GLV-1h68 or GLV-1h99 in 100 μl of PBS. As described previously, the growth of tumors treated with GLV-1h68 can be divided into three phases: growth, inhibition, and regression (Zhang et al. (2007) *Cancer Res.* 67(20):10038-46). The tumors treated with GLV-1h99 showed similar growth pattern to the GLV-1h68 tumors, however, the tumors started to shrink one week earlier for the GLV-1h99 injected mice as compared with GLV-1h68-treated tumors. The tumor started to shrink after day 13 following virus administration for the GLV-1h99 mice, whereas the GLV-1h68 mice did not exhibit tumor shrinkage until after day 21 following virus administration. The degree of initial tumor shrinkage also slightly faster in the GLV-199 injected mice. Near complete eradication of the tumor was observed around 53-57 days following viral administration. Expression of hNET did not have any negative effects on vaccinia virotherapy. The accelerated tumor shrinkage by GLV-1h99 is consistent with the enhanced viral replication in tissue culture in comparison with GLV-1h68.

Similar results also were observed in a human breast tumor (GI-101A) xenograft nude mouse model treated with GLV-1h68 and GLV-1h99. To develop subcutaneous (s.c) breast tumors in mice, human breast cancer GI-101A cells (Rumbaugh-Goodwin Institute for Cancer Research Inc. Plantation, Fla.; U.S. Pat. No. 5,693,533) at a dose of 5×10$^6$ cells/0.1 ml/mouse were injected s.c. into the right hind leg of 6-8 week old female athymic mice. On day 31 after GI-101A cell implantation, when median tumor size was about 500 mm$^3$, GLV-1h68 and GLV-1h99 viruses at the dose of 10$^7$ PFU/mouse were injected i.v. into the femoral vein. Tumor shrinkage for the GLV-1h99 virus was observed at around day 24, whereas the GLV-1h68 virus did not show tumor shrinkage in this experiment until after day 30. Previously published results for the GLV-1h68 virus which showed that GLV-1h68 viruses show tumor shrinkage of G101A tumors earlier (around day 25) by either tail vein or femoral vein administration of the virus (see Zhang et al. (2007) *Cancer Res.* 67(20):10038-46); though no comparison was made to GLV-1h99 viruses in the particular experiment. When compared to GLV-1h68, overall GLV-1h99 appeared to shrink tumors faster in both xenograft models.

Example 5

Toxicity Study on GLV-1h99 Viruses

The percentage of body weight change following intravenous administration of the GLV-1h99 viruses was examined in immunocompetent animals. C57BL/6 female mice were injected i.v. with either 1×10$^7$ pfu or 1×10$^8$ pfu of GLV-1h68 or GLV-1h99 viruses. Body weights were monitored once a week and calculated ate percentage body weigh over time. Neither the GLV-1h68 or GLV-1h99 viruses caused any significant decrease in body weight over the course of the study for either dosage of virus tested. All mice exhibited comparable increases in body weight over the 60 day period, with the GLV-1h68 infected mice show slightly higher increases in body weight, which may be reflective of the lower replication rate of the virus.

Since modifications will be apparent to those of skill in this art, it is intended that this invention be limited only by the scope of the appended claims.

SEQUENCE LISTING (112 sequences)

SEQ ID NO: 1 - DNA, 203057 bp, Vaccinia virus
  GLV-1h68
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgcagatctcgagttatgatctacttccttaccgtgcaataaattagaatatattttctacttttacgagaaattaattattgtatttattatttatgggtgaaaaacttactataaaaagcgggtgggtttggaattagtgaaagcttaaaaattgaaattttattttttttttttggaatataaataagctcgaagtcgacagatctaggcctggtaccaggaggaggaattcagcttaaagatgacttcgaaagtttatgatccagaacaaaggaaacggatgataactggtccgcagtggtgggccagatgtaaacaaatgaatgttcttgattcatttattaattattatgattcagaaaaacatgcagaaaatgctgttatttttttacatggtaacgcggcctcttcttatttatggcgacatgttgtgccacatattgagccagtagcgcggtgtattataccagatcttattggtatgggcaaatcaggcaaatctggtaatggttcttataggttacttgatcattacaaatatcttactgcatggtttgaacttcttaatttaccaaagaagatcatttttgtcggccatgattggggtgcttgtttggcatttcattatagctatgagcatcaagataagatcaaagcaatagttcacgctgaaagtgtagtagatgtgattgaatcatgggatgaatggcctgatattgaagaagatattgcgttgatcaaatctgaagaaggagaaaaaatggttttggagaataacttcttcgtggaaaccatgttgccatcaaaaatcatgagaaagttagaaccagaagaatttgcagcatatcttgaaccattcaaagagaaaggtgaagttcgtcgtccaacattatcatggcctcgtgaaatcccgttagtaaaaggtggtaaacctgacgttgtacaaattgttaggaattataatgcttatctacgtgcaagtgatgatttaccaaaaatgtttattgaatcggatccaggattcttttccaatgctattgttgaaggcgccaagaagtttcctaatactgaatttgtcaaagtaaaaggtcttcatttttcgcaagaagatgcacctgatgaaatgggaaaatatatcaaatcgttcgttgagcgagttctcaaaaatgaacaagcggccgccgccaccatgagcaagggcgaggaactgttcactggcgtggtcccaattctcgtggaactggatggcgatgtgaatgggcacaaattttctgtcagcggagagggtgaaggtgatgccacatacggaaagctcaccctgaaattcatctgcaccactggaaagctccctgtgccatggccaacactggtcactaccttcacctatggcgtgcagtgcttttccagatacccagaccatatgaagcagcatgactttttcaagagcgccatgcccgagggctatgtgcaggagagaaccatctttttcaaagatgacgggaactacaagacccgcgctgaagtcaagttcgaaggtgacaccctggtgaatagaatcgagctgaagggcattgactttaaggaggatggaaacattctcggccacaagctggaatacaactataactcccacaatgtgtacatcatggccgacaagcaaaagaatggcatcaaggtcaacttcaagatcagacacaacattgaggatggatccgtgcagctggccgaccattatcaacagaacactccaatcggcgacggccctgtgctcctcccagacaaccattacctgtccacccagtctgccctgtctaaagatcccaacgaaaagagagaccacatggtcctgctggagtttgtgaccgctgctgggatcacacatggcatggacgagctgtacaagtgagcggccgccctgctagcaagcttgctagcggccgctcgagatctgcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgcaatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattagatcgataaaaattaattaattacccgggtaccaggcctagatctgtcgagatccggtggtggtgcaaatcaaagaactgctcctcagtggatgttgcctttacttctaggcctgtacggaagtgttacttctgctctaaaagctgctgcagggggggggggggggtgggggggccggttagggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtatcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactgaaaaaaaaaaaaaaaaaaaaaaaaaaaaaaaaaaaaaaaaaaaaaaaaaaaaaaaaaaaaaaaaaaaaaaaaaaaaaaaaagtaccttctgaggcggaaagaaccagccggatctcgacttcgagcttatttatattccaaaaaaaaaaaataaaatttcaatttttaagctttcactaattccaaacccacccgctttttatagtaagtttttcacccataaataataaatacaataattaatttctcgtaaaagtagaaaatatattctaatttattgcacggtaaggaagtagatcataactcgagcatgggagatcccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatccaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagaaataataggaggtaatgatatgtatcaatcggtgtgtagaaagtgttacatcgactcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgagacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcggtacccggggatcagcttgcatgcctgcagcaattcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaacattctagtcgaggaattcatttatagcatagaaaaaaacaaaatgaaattctactatatttttacatacatatattctaaatatgaaagtggtgattgtgactagcgtagcatcgcttctagacatctatatactatatagtaataccaatactcaagactacgaaactgatacaatctcttatcatgtgggtaatgttctcgatgtcgatagccatatgcccggtagttgcgatatacataaactgatcactaattccaaacccacccgctttttatagtaagtttttcacccataaataataaatacaataattaatttctcgtaaaagtagaaaatatattctaatttattgcacggtaaggaagtagaatcataaagaacagtgacggatccccgatccccgacctgcaggcatgcaagctcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctagatttttgacttacataaatgtctgggatagtaaaatctatcatattgagcggaccatctggtttaggaaagacagccatagccaaaagactatgggaatatatttggatttgtggtgtcccataccactagatttcctcgtcctatggaacgagaaggtgttgattaccattacgttaacagagaggccatctggaagggaatagccgccggaaactttctagaacatactgagtttttaggaaatatttacggaacttctaaaacagctgtgaatacagcggctattaataatcgtatttgtgtgatggatctaaacatcgacggtgttagaagtcttaaaaatacgtacctaatgccttactcggtgtatataagacctacctctcttaaaatggttgagaccaagcttcgtcgtagaaacactgaagctaacgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 2 - DNA, 190167 bp, Vaccinia virus
  LIVP genome
ttatgagaccatcaaagagagaaagagaataaaaatatttttgtaaaactttttttatgagaccatcaaagagagaaagagaataaaaatatttttgtaaaacttttttatgagaccatcaaagagagaaagagaataaaaatatttttgtaaaacttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcagaaagaggtttaatatttttgtgatactctgaaaggaaataggaataggaataggaatagtgtcataatcgtatcacactattgagacagaaaaagaagaagtcgcgagaggtaactttttgtgaatgtagttaagaacatttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgaatccatccttgacctcaagttcagatgattccttgcacatgtctccgatacgaacgctaaactctagattcttgacgcattttgtatcgacgatcgttgaaccgatgatatcttcgtaactcactttcttatgagagatgttagacccgagtactggatgggtcttgatgtcgctgtctttctcttcttcgctacatctgatgtcgatagacacttcacagtctttgatcatagcaagagcttcttcatgagtgatcgcgggagagtccttaccttgtcctggggacacgctggacaatctagcattcactgtgtttccatcagcggattctgagatggatttaatctgaggacatttggtgaatccaaagttcattctcagacctccaccgatgatggagtaataagtggtaggaggatctacatcctcgactgatgtggaatcatcttctgattccacctcgggatctggatctgactcggactctgtaatttccgttacggattggcaaatcttatcattggtcggtgtttggtcttgctttgtgactttgataataacatcgattcccatatgatgtttgttttcttcttccgtacacgaggaggaggatgaggatgattgctgaagactggcaggcatagcagctgccgccaggcacatgcatgccaggacgatatattgtttcataattgctattgattgagtactgttctttatgattctacttccttaccgtgcaataaattagaatatattttctacttttacgagaaattaattattgtatttattatttatgggtgaaaaacttactataaaaagtgggtgggtttggaattagtgatcagtttatgtatatcgcaactaccgggcatatggctatcgacatcgagaacattacccacatgataagagattgtatcagtttcgtagtcttgagtattggtattactatatagtatatagatgtcgcccactagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaacggagaagtatccatcacgaaatacgggattacagtctttatgattcatagtaatagttagttccgacgttgagatggattcgctgagaccggtagtggtcgtccgagtacacgacgtgtcgttaactggatacaggttaatttccacatcgatatagttaaacgtatttctgggtacgggttcgcatttatctgcggaagagacggtgtgagaatatgttccgagaccacacggagaacagatgacgtctccggatactccgtatcctattccacattttgtttgggaaacacatgccttgcatccggatgatcctttgagaagacaataatatccgggagagcattcacagattctattgtgagtcgtgttacacgatcgcgtcttccgttacaacttagacaagcgggtaaatgattattgcgagatgtgaaggtacccgaaccacacggcgtacatcgtgtgttagtcttgctatcgcataatctggaagcgtatgttcccggacacaaattatggcgtttgtattcgttgtctttacactttccatcggatggtgcatgcggtgctatatctcttccgtttattattatacatgagagaaacaatatatacgagtataatacggacttcatgatttaataatgtagtaatcgttgtcttgttcctgtttcctacttctccaatcatatagatattttctttctatcatggataatatttgtaatggttctttccgtacaacatactgtttagatgatattgcgcataatttccggaggcaaatacgatagtctagattgaccgatggtagactctaatttattgagtgctttgtcgacgagtttacttttacgctccatcgatagatggcactgttctatgagatcgtcgtacatgggaaatgaaatgtgactgtctgaatgtatggctttaagatagctgtgataccgtatacaggtcggtgtcggagattcgaatctctttgaggcgacttatgtcacgatgatggaatctatcttatcgaatgatatatttttcataaatacacttttatagtcctcgtttaaacagaatttactatgtagttccgcgaatgactcgtcccttaataggcagtaggctagtatcttttttacgtagtaatcgtcgtagggagagacatcttgtagaacaacgatttcgttttgttttctcttctgtaactgcttttctggatggccgtattgattatcgagcgtgatactcgctccatattccaataaccgctttgcaaattgtatattattgacatcgaccgcgtaatatagtagagttatcgatcatatctatatcatccatgtacttgcttagtatatcaaatacatctatcagtatggtttcataacagtgatacccgcaattattaaatctcgataatatcagaccgtacatacatagacggccattgttcgatacgtgatttacagccgcgtgtccatattttccacgataaaccttacgacgtttacatcgacgagattattattaacaaagtagtcgtgtagaggatagttgttgtccgttatctaacatgcatcgaacgaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataataatttaacaatctctatatctatggttgagaaagaccagtagtattggatgggtaaagatcctccttcgtctctgccatggatggaaacattgttatcgatcaaacatttaattacatccttggatagagattgagattctctatgagacgatatatagtaatgaagagagttcttacacatatcactgtcgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgatattatccgaatacagatcgaaatcatttatattcgacttgagttcgttagaggaatttgaatagctggatatcagtagatgcacaatctgagattttacgtatctatgcttactgtatactcctagcggagttaatccttcgttgtttctacaaagtctctcgactccgcgagagaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatagtgcactctctaccacaataatccatagctattctggtgctaattattcctatttcacgaaggcaatcattcctcataagatgataaaaagtgtagtggagatttagtatttagcagtgcggatatgatccaagagggtgagatagtcgttctcgttcagaatctttcgcagcataagtagtatgtcgatatacttatcgttgaagactctttataaaagtctatttgtttatatttattgcggatagcagtatttccctataaaaagtatacgtcctgtggtgtctttaatcatgtacatgaatggatggtttatgtagaccttcgtacgatataccatcgaaaagttaatcgtaaatactcctgtaacggccgatgcttctgtatactcctcattaacatctataaacgtcgtatgtagaaatttttctacagtgatagtttcattacacatcttgctaaaatctgcataatatccgaatatattagtaagtcctaaattttctaaaatcggtaccagattatacggttctgtcatttccactttaaactttggcatatacaagtctatacttttagtagataacataccacaccattttttaaatttttcatctgttatatttttttctatgttatatataccttctatgtcgtccggtagtataattaccatactagagtttccctcgtatggaatatcgataatagagaatcctccgaataattcattaatatgtacatattgcaagttattctcggtacccaccatcatatcaacgctggtaactatattcttagaaatataaaacttgtctgtatatgtaagatgtttagaaaatggatatttccacattgctttaaaatggacggcgctaacaactgtcatacgagtattaatggatagcggactagtcaataaggaattaattttaccatttgtcattgtcttaacccattcgttgattagttcctttgtttggttagcattattaaagtttacagtttgaaaatcgtcttttattttttgtaggaaggaggcgtggaactcgatactatcgctaccgtatattttatttgcggtagctagtgtcgcacaatacggaatatctacctccatgtcatcattattgtcatcgggtgtattctcattcatattctctatatattttgatagttgttcagctgtagaaccagctgctccatgatttagaatagataaagtagataaaatggaaactggagaaatcaaaacattttcatcagggtgttttaagattagttctttaaagatatccatggtatagacctaacgataacgatatatatcataaataaataatgttaaatttcaatttatgtttgtaccccgtattcatacttaacaaattggtattgcgtacacaatcaatcatattacataccattaataatgcaagcataaaaaattgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacagaatccatcaaaaatgttgataaattatctgatgttgttgttcgctgctatgataatcagatcattcgccgatagtggtaacgctatcgaaacgacattgccagaaattacaaacgctacaacagatattccagctatcagattatgcggtccagagggagatggatattgtttacacggtgactgtatccacgctagagatattgacggtatgtattgtagatgctctcatggttatacaggcattagatgtcagcatgtagtattagtagactatcaacgttcagaaaacccaaacactacaacgtcatatatcccatctcccggtattatgcttgtattagtaggcattattatgtgttgtctattatctgtttataggttcactcgacgaactaaactacctatacaagatatggttgtgccataatttttataaatttttttatgagtatttttacaaaaatgtataaagtgtatgtcttatgtatatttataaaaatgctaagtatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcaaatacagtatccgattgagattttgcatacaatactagtctagaaagaaatttgtaatcatcttctgtgacgggagtccatatatctgtatcatcgtctagtttatcagtgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccatttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtgttatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccggtcggtaattgtctgccggtgtaatagaattatatatatctatctattacaccggccttgtatacataataataagttgtggtagtatgatctccatatttataatttaggactttgtattcagtatttttggaatcataaaaaataaaaaaaagttttactaatttaaaatttaaaaagtatttacatttttttcactgtttagtcgcggatatggaattcgatcctgccaaaatcaatacatcatctatagatcatgtaacaatattacaatacatagatgaaccaaatgatataagactaacagtatgcattatccgaaatattatatcaatatcacaaaaataaatacacatttggctaatcaatttcgggcttggaaaaaacgtatcgccggaagggactatatgactaacttatctagagatacaggaatacaacaatcaaaacttactgaaactatacgtaactgtcaaaaaaatagaaacatatatggtctatatatacactacaatttagttattaattggataaccgatgtgattatcaatcaatattaagagggttggtaaattggtacatagctaataatacctatactccaaatacacccaataatacaacaaccatttctgagttggatatcatcaaaatactaaataaatacgaggacgtgtatagagtaagtaaagaaaaagaatgtggaatttgctatgaagttgtttactcaaaacgatagatactttggtttattggattcgtgtactcatatattttgcataacatgcatcaatatatggcatagaacacgaagagaaaccggtgcgtcggataattgtcctatatgccgtacccgttttagaaacataacaatgagcaagttctataagctagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacacaactacttcagcaaacattctttttataaatgccatctagcgtagcgaggacacaagtgaacctataattatcaaatttattagtatcagtcacatgaaggactttacgtagagtgacgattccactatctgtggtacgaacggtttcatcttctttgatgccatcacccagatgttctataaacttggtatcctcgtccgatttcatatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattctcatcttgccaaaatatcactagaaaaaatttatttatcagttttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattggcatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagacccttttttgtatgtataagtgtaaaaattataacatccatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagctccatattccactagagggatatcgccgaatgtcatatactcaattagtatatgttggaggacatccgagttcattgttttcaatatcaaagagatggtttccttatcatttctccatagtggtacaatactacacattattccgtgcggctttccattttccaaaaacaatttgaccaaatctaaatctacatctttattgtatctataatcactatttagataatcagccataattcctcgagtgcaacatgttagatcgtctatatatgaataagcagtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataattttagaaacaggatcattgtcattacataattttctataactgaacgatggttttcacatttaacactcaagtcaaatccatgttctaccaacacctttatcaagtcaacgtctacatttttggatttcatatagctgaatatattaaagttatttatgttgctaaatccagtggcttctagtagagccatcgctatatccttattaactttaacatgtctactatttgtgtattcttctaatggggtaagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctttcaacatctgtttaagttcatcaagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaatacctccattaaccccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttgactaaagtttctagtcacaagagcaatactaccaacctacactattatatgattatagtttctatttttataggaacgcgtacgagaaaatcaaatgtctaatttctaacggtagtgttgataaacgattgttatccgcggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccttaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgactcaatacaatgataaagtatactacatccatgtttatctattttgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattaggatattattacataaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaatcgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatattgatgttatcagaacatagatattcgaatatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctggttttgttagatggttgcatcgtgctttaacgtcaatggtacaaattttatcctcgctttgtgtatcatattcgtccctactataaaattgtatattcagattatcatgcgatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttattaaatggttgataatatggatcctcgtgacaatttccgaagatggaaataagacataaacacgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttctcttctttaactttatactttttactaatcatatttagactgatgtatgggtaatagtgtttgaagagctcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaattgcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataccacacatgtcttaaagtttattaattaattacatgttgttttatatatatcgctacgaatttaaagagaaattagtttaggaagaaaaattatctatctacatcatcacgtctctgtattctacgatagagtgctactttaagatgcgacagatccgtgtcatcaaatatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactaatcataactagttatcaaagtgtctaggacgcgtaattttcatatggtatagatcctgtaagcattgtctgtattctggagctattttctctatcgcattagtgagttcagaatatgttataaatttaaatcgaataacgaacataactttagtaaagtcgtctatattaactcttttattttctagccatcgtaataccatgtttaagatagtatattctctagttactacgatctcatcgttgtctagaatatcacatactgaatctacatccaattttagaaattggtctgtgttacatatctcttctatattattgttgatgtattgtcgtagaaaactattacgtagaccattttctttataaaacgaatatatagtactccaattatctttaccgatatatttgcacacataatccattctctcaatcactacatctttaagattttcgttgttaagatatttggctaaactatataattctattagatcatcaacagaatcagtatatatttttctagatccaaagacgaactctttggcgtcctctataatattcccagaaaagatattttcgtgttttagtttatcgagatctgatctgttcatatacgccatgattgtacggtacgttatgataaccgcataaaataaaaatccattttcatttttaaccaatactattcataattgagattgatgtaatactttgttactttgaacgtaaagacagtacacggatccgtatctccaacaagcacgtagtaatcaaatttggtgttgttaaacttcgcaatattcatcaatttagatagaaacttatactcatcatctgttttaggaatccatgtattattaccactttccaacttatcattatcccaggctatgtttcgtccatcatcgttgcgcagagtgaataattcttttgtattcggtagttcaaatatatgatccatgcatagatcggcaaagctattgtagatgtgatttttcctaaatctaatataaaactcgtttactagcaaacactttcctgatttatcgaccaagacacatatggtttctaaatctatcaagtggtggggatccatagttatgacgcagtaacatatattattacattcttgactgtcgctaatatctaaatatttattgttatcgtattggattctgcatatagatggcttgtatgtcaaagatatagaacacataaccaatttatagtcgcgctttacattctcgaatctaaagttaagagatttagaaaacattatatcctcggatgatgttatcactgtttctggagtaggatatattaaagtctttacagatttcgtccgattcaaataaatcactaaataatatcccacattatcatctgttagagtagtatcattaaatctattatattttatgaaagatatatcactgctcacctctatatttcgtacatttttaaactgtttgtataatatctctctgatacaatcagatatatctattgtgtcggtagacgataccgttacatttgaattaatggtgttccattttacaacttttaacaagttgaccaattcatttctaatagtatcaaactctccatgattaaatattttaatagtatccattttatatcactacggacacaaagtagctgacataaaccattgtataatttttatgttttatgtttattagcgtacacattttggaagttccggcttccatgtatttcctggagagcaagtagatgatgaggaaccagatagtttatatccgtacttgcacttaaagtctacattgtcgttgtatgagtatgatcttttaaacccgctagacaagtatccgtttgatattgtaggatgtggacatttaacaatctgacacgtgggtggatcggaccattctcctcctgaacacaggacactagagttaccaatcaacgaatatccactattgcaactataagttacaacgctcccatcggtataaaaatcctcgtatccgttatgtcttccgttggatatagatggaggggattggcatttaacagattcacaaataggtgcctcgggattccataccatagatccagtagatcctaattcacaatacgatttagattcaccgatcaactgatatccgctattacaagagtacgttatactagagccaaagtctactccaccaatatcaagttggccattatcgatatctcgaggcgatgggcatctccgtttaatacattgattaaagagtgtccatccagtacctgtacatttagcatatataggtcccattttttgctttctgtatccaggtagacatagatattctatagtgtctcctatgttgtaattagcattagcatcagtctccacactattcttaaatttcatattaatgggtcgtgacggaatagtacagcatgatagaacgcatcctattcccaacaatgtcaggaacgtcacgctctccaccttcatatttatttatccgtaaaaatgttatcctggacatcgtacaaataataaaaagcccatatatgttcgctattgtagaaattgtttttcacagttgctcaaaaacgatggcagtgacttatgagttacgttacactttggagtctcatctttagtaaacatatcataatattcgatattacgagttgacatatcgaacaaattccaagtatttgattttggataatattcgtattttgcatctgctataattaagatataatcaccgcaagaacacacgaacatctttcctacatggttaaagtacatgtacaattctatccatttgtcttccttaactatatatttgtatagataattacgagtctcgtgagtaattccagtaattacatagatgtcgccgtcgtactctacagcataaactatactatgatgtctaggcatgggagacttttttatccaacgatttttagtgaaacattccacatcgtttaatactacatatttctcatacgtggtataaactccacccattacatatatatcatcgtttacgaataccgacgcgcctgaatatctaggagtaattaagtttggaagtcttatccatttcgaagtgccgtgtttcaaatattctgccacacccgttgaaatagaaaattctaatcctcctattacatataactttccatcgttaacacaagtactaacttctgattttaacgacgacatattagtaaccgttttccattttttcgttttaagatctacccgcgatacggaataaacatgtctattgttaatcatgccgccaataatgtatagacaattatgtaaaacatttgcattatagaattgtctatctgtattaccgactatcgtccaatattctgttctaggagagtaatgggttattgtggatatataatcagagtttttaatgactactatattatgttttataccatttcgtgtcactggctttgtagatttggatatagttaatcccaacaatgatatagcattgcgcatagtattagtcataaacttgggatgtaaaatgttgatgatatctacatcgtttggatttttatgtatccactttaataatatcatagctgtaacatcctcatgatttacgttaacgtcttcgtgggataagatagttgtcagttcatcctttgataattttccaaattctggatcggatgtcaccgcagtaatattgttgattatttctgacatcgacgcattatatagttttttaattccatatcttttagaaaagttaaacatccttatacaatttgtgaaattaatattatgaatcatagtttttacacatagatctactacaggcggaacatcaattattatggcagcaactagtatcatttctacattgtttatggtgatgtttatcttcttccagcgcatatagtctaatagcgattcaaacgcgtgatagtttataccattcaatataatcgcttcatcctttagatggtgatcctgaatgcgtttaaaaaaattatacggagacgccgtaataatttccttattcacttgtataatttccccattgatagaaaatattacgctttccattcttaaagtactataagtaattatagtataatgtaaacgtttatatattcaatatttttataaaaatcattttgacattaattcctttttaaatttccgtctatcatctatagaaacgtattctatgaatttataaaatgcttttacgtgtcctatcgtaggcgatagaaccgctaaaaagcctatcgaatttctacaaaagaatctgttatatggtatagggagagtataaaacattaaatgtccgtacttattaaagtattcagtagccaatcctaactctttcgaatacttattaatggctcttgttctgtacgaatctatttttttgaacaacggacctagtggtatatcttgttctatgtatctaaaataatgtctgactagatccgttagtttaatatccgcagtcatcttgtctagaatggcaaatctaactgcgggtttaggctttagtttagtttctatatctacatctatgtctttatctaacaccaaaaatataatagctaatattttattacaatcatccggatattcttctacgatctcactaactaatgtttctttggttatactagtatagtcactatcggacaaataaagaaaatcagatgatcgatgaataatacatttaaattcatcatctgtaagatttttgagatgtctcattagaatattattagggttagtactcattatcattcggcagctattacttattttattatttttcaccatatagatcaatcattagatcatcaaaatatgtttcaatcatcctaaagagtatggtgaatgactcttcccatctaatttctgaacgttcaccaatgtctctagccactttggcactaatagcgatcattcgcttagcgtcttctatattattaactggttgatttaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgcttagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagatcaatggtgtgatgttgattaggtcttttacgaatttgatatagaatagcgtttacatattctccataatggtcaatcgccatttgttcgtatgtcataaattctttaattatatgacactgtgtattatttagttcatccttgttcattgttaggaatctatccaaaatggcaattatactagaactataggtgcgttgtatacacatattgatgtgtctgtttatacaatccatgatatttggatccatgctactaccttcgggtaaaattgtagcatcatataccatttctagtactttaggttcattattatccattgcagaggacgtcatgatcgaatcataaaaaaatatattatttttatgttattttgttaaaaataatcatcgaatacttcgtaagatactccttcatgaacataatcagttacaaaacgtttatatgaagtaaagtatctacgatttttacaaaagtccggatgcataagtacaaagtacgcgataaacggaataataatagatttatctagtctatctttttctatagctttcatagttagatacatggtctcagaagtaggattatgtaacatcagcttcgataaaatgactgggttatttagtcttacacattcgctcatacatgtatgaccgttaactacagagtctacactaaaatgattgaacaatagatagtctaccattgtttcgtattcagatagtacagcgtagtacatggcatcttcacaaattatatcattgtctaatagatatttgacgcatcttatggatcccacttcaacagccatcttaaaatcatattgctttcctttatcattaataatttctagaacatcatctctatcataaaagatacaaatattaactgtttgatccgtaataacattgctagtcaatagcaatttgttaataagatgcgctgggctcaatgtcttaataagaagtgtaagaggactatctccgaatttgttttgtttattaacatccgttgatggaagtaaaagatctataatgtctacattcttgactgttttagagcatacaatatggagaggtgtatttccatcatgatctggttttgagggactaattcctagtttcatcatccatgagattgtagaagcttttggattgtctgacataagatgtctatgaatatgatttttgccaaatttatccactatcctggcttcgaatccgatggacattatttttttaaacactctttctgaaggatctgtacacgccaacaacggaccacatccttcttcatcaaccgagttgttaatcttggctccatactgtaccaataaatttattctctctatgacttcatcatctgttcccgagagataatatagaggtgttttatgctgtttatcacacgcgtttggatctgcgccgtgcgtcagcagcatcgcgactattctattattattaattttagaagctatatgcaatggataatttccatcatcatccgtctcatttggagagtatcctctatgaagaagttcttcgacaaatcgttcatctagtcctttaattccacaatacgcatgtagaatgtgataattatttccagaaggttcgatagcttgtagcatattcctaaatacatctaaatttttactattatatttggcataaagagatagataatactcggccgacataatgttgtccattgtagtataaaaattaatatttctatttctatttctgtatatttgcaacaatttactctctataacaaatatcataacttagtttttttatgtcaagaaggcactggtttagttcatctataaatgtcacgccataactaccacgcatgccatactcagaattatgataaagatatttatccttggggtgtaggtaatggggattaatctttgttggatcagtctctaagttaacacatgtcacacatgatccatttatagttatatcacacgatgatgatttatgaattgattccggaagatcgctatcgtattttgtggttccacaattcatttccatacatgttattgtcacactaatattatgatgaactttatctagccgctgagtggtaaacaacagaacagatagtttattatctttaccaacaccctcagccgctgccacaaatctctgatccgtatccatgatggtcatgtttatttctagtccgtatccagtcaacactatgttagcatttctgtcgatatagctttcactcatatgacactcaccaataatagtagaattaatgtcgtaatttacaccaatagtgagttcggcggcaaagtaccaataccggtaatcttgtcgaggaggacatatagtattcttgtattctaccgaatacccgagagatgcgatacaaaagagcaagactaatttgtaaaccatcttactcaaaatatgtaacaatagtacgatgcaatgagtaagacaataggaaatctatcttatatacacataattattctatcaattttaccaattagttagtgtaatgttaacaaaaatgtgggagaatctaattagtttttctttacacaattgacgtacatgagtctgagttccttgtttttgctaattatttcatccaatttattattcttgacgatatcgagatcttttgtataggagtcaaacttgtattcaacatgcttttctataatcattttagctatttcggcatcatccaatagtacattttccagattagcagaatagatattaatgtcgtatttgaacagagcctgtaacatctcaatgtctttattatctatagccaatttaatgtccggaatgaagagaagggaattattggtgtttgtcgacgtcatatagtcgagcaagagaatcatcatatccacgtgtccattttttatagtgatgtgaatacaactaaggagaatagccagatcaaaagtagatggtatctctgaaagaaagtaggaaacaatacttacatcattaagcatgacggcatgataaaatgaagttttccatccagttttcccatagaacatcagtctccaatttttcttaacaaacagttttaccgtttgcatgttaccactatcaaccgcataatacaatgcggtgtttcccttgtcatcaaattgtgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgtatctttactagagagaaagcttttcagctgcttagacttccaagtattaattcgtgacagatccatgtctgaaacgagacgctaattagtgtatattttttcattttttataattttgtcatattgcaccagaattaataatatctttaatagatctgattagtagatacatggctatcgcaaaacaacatatacacatttaataaaaataatatttattaagaaaattcagatttcacgtacccatcaatataaataaaataatgattccttacaccgtacccatattaaggagattccaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgagacgaccaatagtctaattttgcagccgtgatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatgcacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggcggacgctgaacacgctaacgatagtatcaataacgcaatcatgattttatggtattaataattaaccttatttttatgttcggtataaaaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcacccgcattgggcaacgaataacaaaatgcaagcatcttgttaacgggctcgtaaattgggataaaaattatgtttttattgtcttatatctattttattcaagagaatattcaggaatttctttttccggttgtatctcgtcgcagtatatatcatttgtacattgtttcatattttttaatagtttacaccttttagtaggactagtatcgtacaattcatagctgtattttgaattccaatcacgcataaaaatatcttccaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacgccgcttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattccttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattaacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtttctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatcttattgtttgttccctggagtatgagagtcggggggtgttaatcttggaaattatttttctaaccttgttggtagccttcaagacctgactagcaaatccagccttaattttttcatgattgactaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaataggtttccaatatttacaatatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtaagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatttgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttataaatgaaattgtcgccaatcttacacccaaccccttgttatccattagcatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccattatctatatcatctacataatctatgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcagaacttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgatccacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgcctcatataccacttaatgacaaaatcaactacataatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaagataaagtttatacaagtgtagatgataaattctacagaggttaatatagaagcacgtaataaattgacgacgttatgactatctatatatacctttccagtatatgagtaaataactatagaagttaaactgtgaatgtcaaggtctagacaaacccttgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctagagaaaaatgattatctttttgagacataactcccattttttggtattcacccacacgtttttcgaaaaaattagtttttccttccaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggatactgcatctgttataatagatctaacggtttcttcactcggtggatgcaataaatgtttaaacatcaaacatgcgaaatcgcagtgcagaccctcgtctctactaattagttcgttggaaaacgtgagtccgggcattaggccacgctttttaagccaaaatatggaagcgaatgatccagaaaagaaaattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggattttttgtacatcgatatcgccgcaatcactacaataattacaagtattattgatagcattgttattagtactatcataattaaattatctacattcatgggtgctgaataatcgttattatcatcattatcattttgtaattgtgacatcatactagataaatcgtttgcgagattgttgtgggaagcgggcatggaggatgcattatcattattatttaacgccttccatttggattcacaaatgttacgcacattcaacattttatggaaactataattttgtgaaaacaaataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgtcagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatatgattagtaatgaccattaaaataaaaaatattcttcataaccggcaagaaagtgaaaagttcacattgaaactatgtcagtagtatacatcatgaaatgatgatatatatatactctattttggtggaggattatatgatataattcgtggataatcatttttaagacacatttctttattcgtaaatcttttcacgttaaatgagtgtccatattttgcaatttcttcatatgatggcggtgtacgtggacgaggctgctcctgttcttgttgtggtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatctaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcaacagggtagttcgtagattttaatgtataacagagccatctgtaaaaagataaactttatgtattgtaccaaagatttaaatcctaatttgatagctaactcggtatctactttatctgccgaatacagtgctaggggaaaaattataatgtttcctctttcatattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgagagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgacggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaacaattaactattttgtctctgtttttaacacctccacagtttttaatttctttagtaatgaaattattcacaatatcagtatcttctttatctaccagagattttactaacttgataaccttggctgtctcattcaatagggtagtaatatttgtatgtgtgatattgatatctttttgaattgtttcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctactgacgatagtatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggtttaatgttatatgtaacattgagtaaatccttaagttcataatcatcactgtcatcagttatgtacgatccaaacaatgtttctaccggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcgatggaatgcaaaaccccatagtgaaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtatagaacaacgaaattatactagagttgttaaagttaatattttctatgagctgttccaataaattatttgttgtgactgcgttcaagtcataaatcatcttgatactatccagtaaaccgtttttaagttctggaatattatcatcccattgtaaagcccctaattcgactatcgaatatcctgctctgatagcagtttcaatatcgacggacgtcaatactgtaataaaggtggtagtattgtcatcatcgtgataaactacgggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattattcactataatataatctagacagatagatgattcgataaatagagaaggtatatcgttggtaggataatacatccccattccagtattctcggatactctattgatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacaattattgggccagtatactgttagcaacggtatatcgaatagattactcatgtaacctactagaatgatagttcgtgtactagtcataatatctttaatccaatctaaaaaatttaaaattagattttttacactgttaaagttaacaaaagtattacccgggtacgtggatatcatatatggcattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagggaacttacgatacatctgtttcctataatcgttaaattttacaaatctataacatgctaaaccttttgacgacagccattcattaatttctgatatggaatctgtattctcgataccgtatcgttctaaagccagtgctatatctccctgttcgtgggaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatcttgtaatattcatcatcgacataatactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctataacgtctctattttctatttttaattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcatctagacttttggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagctgacctgagtttatcaataactacatcggtatctagatctctagaatatcccaataggtgttccggagaatcagtaaagaacactccacctataggattcttaatatgatacgcagtgctaactggcaaacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcatcatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccgatgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtattaatatagcaacagtagttcttgctcctccttgattctagcatcctcttcattattttcttctacgtacataaacatgtccaatacgttagacaacacaccgacgatggcggccgctacagacacgaatatgactaaaccgatgaccatttaaaaacccctctctagctttcacttaaactgtatcgatcattcttttagcacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattctttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatccttttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattgcatgttttcatattcattaggattatcaaatctttaatcttattacgattgtatgcgttgatattacaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgtttttttctatgctataaatgaattctcattttgcatctgctcatactccgttttatattaataccaaagaaggaagatatctggttctaaaagccgttaaagtatgcgatgttagaactgtagaatgcgaaggaagtaaagcttcctgcgtactcaaagtagataaaccctcatcgcccgcgtgtgagagaagaccttcgtccccgtccagatgcgagagaatgaataaccctggaaaacaagttccgtttatgaggacggacatgctacaaaatatgttcgcggctaatcgcgataatgtagcttctagacttttgtcctaaaatactattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtgataaattttattagaaaggccaaatctataagaaaagtcctagaattagtctgaagaatatctatatcgccgtatagtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtattaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctctacgcaaactttttcacagagcgatagagtttttgataactcgtttttcttaagaaatataaaactactgtctccagagctcgctctatcttttattttatctaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttgtttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcaatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtattttgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacttgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacaaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatcggccttatcgaatactcttccgtcgatgtctacacaggcataaaatgtaggagagttactaggcccaactgattcaatacgaaaagaccaatctctcctagtaatttggcagtactcattaataacggtgacagggttagcatctttccaatcaataatttttttagccggaataacatcatcaaaagacttatgatcctctctcattgatttttcgcgggatacatcatctattatgacgtcagccatagcatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacgcaaccagcaataaaactgaacctactttatcatttttttattcatcatcctctggtggttcgtcgttcctatcaaatgtagctctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcgtgtctaactagtggaggttcgtcagctgctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatatgttaataattgtattgtggttatacggctacaattttataatgagtgaaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattatgactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggagaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagttataagatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcatacctaagcaagaaagatacaggcatagagtttgcggataatgatagacaaaatatatacactctatttcaacaaactggtagaatcgtccatagcaatctaacagaaacgtttagagattatatctttcccggagataagactagctattgggtgtggttaaacgaaagtatagctaatgatgcggatatcgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcggagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattagcatcttattagaatattaacctaactaaaagacataacataaaaactcattacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacctagatgctagtgactattatcccatttcgttgggattacttaaaaagttcgagtttctcatgtctctatataaaggtcctattcccgtatatgaagaaaaagtaaatactgaattcatagccaatggatcgttctctggtagatacgtatcatatcttcgaaagttttctgcccttccaacaaacgagtttattagttttttgttactgacttccattccaatctataatatcttgttctggtttaaaaacacacagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtctcatatgttttaatatttacaagttttttggtccatggtacattagccggacaaatatatgcaaaataatatcgttctccaagttctatagtttctggattatttttattatattcagtaactaaatacatattagggttatctgcggatttataatttgagtgatgcattctactcaacataaataattctagaggagacgatctactatcaaattcggatcgtaaatctgtttctaaagaacggagaatatctatacatacctgattagaattcatccgtccttcagacaacatctcagacagtctggttttgtacatcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatctacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaatagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacataatagtacgactttaaatccattttcccaaatatctttacgaattactttacatataatatcctcatcaacagtcacataattacctgtggttaaaacctttgcaaatgcagcggctttgcctttcgcgtctgtagtatcgtcaccgatgaacgtcatttctctaactcctctatttaatactttacccatgcaactgaacgcgttcttggatatagaatccaatttgtacgaatccaatttttcaaatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataattttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtcactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagttagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacaactgaaataaccgcgtgattattttttggtataattctacacggcatggtttctgtgactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaaccttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcgtctgtgtgtagatcacatcgtacactttttaattctctatagaagagcgacagacatctggagcaattacagacagcaatttctttattctctacagatgtaagatacttgaagacattcctatgatgatgcagaattttggataacacggtattgatggtatctgttaccataattcctttgatggctgatagtgtcagagcacaagatttccaatctttgacaatttttagcaccattatctttgttttgatatctatatcagacagcatggtgcgtctgacaacacagggattaagacggaaagatgaaatgattctctcaacatcttcaatagataccttgctattttttctggcattatctatatgtgcgagaatatcctctagagaatcagtatcctttttgatgatagtggatctcaatgacatgggacgtttaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatttacatcagttttgtattccaaattaaacatggcaacggatttaattttatattcctctattaagtcctcgtcgataataacagaatgtagataatcatttaatccgtcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcattgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattatttttatattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaataatcccgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctgcaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggcattaagaattcgtttttcgacatccgtcaaaaccaattcctttttgcctgtatcatccagttttccatcctttgtaaagaaattattttctactagactattaataagactgataaggattcctccataattgcacaatccaaactttttaacaaaactagactttacgagatctacaggaatgcgtacttcaggttttttagcttgtgattttttcttttgcggacattttctagtaaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaaccccaacaaccggtattattagttgatgtggtagttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagcgcgaaagtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaattatttaacttttcattaatagggatttgacgtatgtagcgtacaaaatgattgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttataccgatcgcagttagaacggttatagcatccaccatttatatctaaaaattagatcaaagaatatgtgacaaagtcctagttgtatactgagaattgacgaaacaatgtttcttacatatttttttcttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcctttatttccacattagatggtaaatccaatagtgaaactatctttttaggaatgtatggactcgcgtttagaggagtaaacgtcttaggcgtcggaaaggatgattcatcaaacgaataaacaatttcacaaatggatgttaatgtattagtaggaaattttttgacgctattggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatccggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaacggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtctactattctatttaattttgtagttaatttatcacatatcacattaattgactttttggtccacttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttccacattaatacagcctattttcgctccaaatgtacattcgaaaaatctgaataaaacatcgatgtcacaatttgtattatccaatacagaatgtttgtgattcgtgttaaaaccatcggagaaggaatagaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaaaaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttttccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggccgtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaacaatttatttctaaatctatgagagatcaacgaaaaggaagagtaggaagagttaatcctggtacatacgtctatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataactttgagaggacgggagaattaactagtattgtacgagaagccattttatctctaaatttacaaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtacctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcattcgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagatgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttataatgacttgataacttactttccagataggaaataccataaatatatttataaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagggaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaacaggtggccaaactccataggtagctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcgaagtttcctattagggttccgcgcttcacgtcacccagcatacttgaatcaccatcctttaaaaaaaatgataagatatcaacatggagtatatcatactcgaattttaattcttctactgactcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgttagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtacgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaataattcattttactttaacgatagtctgttaataaccaatactaaaagtgataatataataaatataggttactagattaaaaatggtgttccaactcgtgtgctctacatgcggtaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgactgttataaaaatgccggtattgatacatcgtctaaacgaatattgggcaaagatatttttctgagccaaaacttcacagacgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcaccgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtgtctataaatgtagactcgacggatgagttaatgtatatttttgccgccttgggcggatctgtaaacatttgggcaattatacctctaagtgcatcagtgttttaccgaggagccgaaaatattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatctagaatggttgttgggctttatcaagtgtattagtcagcatcagcatctggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattttaggaatgttgttttcggatagagttcaatcctttaagatcaacatctttatggcgtttttagattaatactttcaatgagataaatatgggtggcggagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaagaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtaatagaactgtagagggtcaacaatcgttaataaatctgtataataagatgcaaacattatgtagtaaagatgctagtgtaccaatatgcgaatcatttttgcattatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaataccagcgtgaacaacttacagatggataaaacttcctcattaagattgtcatgtggattaagcaatagtgatagattttctactgttcccgtcaatagagcaaaagtagttcaacataatattaaacactcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtgccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggtggtgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccgattgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatctcacaactttactgtttttgaactgttcaaaatatagcatcgatccgtgagaaatacgtttagccgcctttaatagaggaaatcccaccgcctttctggatctcaccaacgacgatagttctgaccagcaactcatttcttcatcatccacctgttttaacatataataggcaggagatagatatccgtcattgcaatattccttctcgtaggcacacaatctaatattgataaaatctccattctcttctctgcatttattatcttgtctcggtggctgattaggctgtggtcttggtttaggccttggtctatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgcattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagctgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatcggctcctggtacacatatacgttatttgagagatcatttctataatttaggagtgatcatcaaatggatgctaattgacggccgccatcatgatcctattttaaatggattgcgtgatgtaactctagtgactcggttcgttgatgaggaatatctacgatccatcaaaaaacaactgcatccttctaagattattttaatttctgatgtaagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaattagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcggtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctatcgccctaatataccattaaaaattgttagatttttccgcaataacatggtaactggagtagagatagccgatagatctgttatttcagtcgctgattaatcaattagtagagatgagataagaacattataataatcaataatatatcttatatcttatatcttatatcttatatcttgtttagaaaaatgctaatattaaaatagctaacgctagtaatccaatcggaagccatttgatatctataatagggtatctaatttcctgatttaaatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattatttttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaagacttgtgggaaaacggaattggaatgtttcggtcactggggtaaagtaagtatttataaaactcatatagttaagcctgaatttatttcagaaattattcgtttactgaatcatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagagaccaatgaattaacttacttattaggtatgatcgttaagaattgtaacttgaatgctgatgaacaggttatccagaaggcggtaatagaatacgatgatattaaaattatttctaataacactaccagtatcaatttatcatatattacatccggcaaaaataatatgattagaagttatatcgtcgcccgacgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttattaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgccaactctcaaaatgctgatttcgacggggatgaggaatggatgatattagaacaaaatcctaaagctgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacgtatggacaacaaaggattgatggtgaaccagcagagactcgagtattgggtagagttttaccttactatcttccagactctaaggatccagaaggaagaggttacattcttaattctttaacaaaaggattaacgggttctcaatattacttttcgatgctggttgccagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaagaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataaatatgtagtagatataatagtcaatagattatacatcaagagagcagaaataaccgaattagtcgtcgaatatatgattgaacgatttatctcctttagcgtcattgtaaaggaatggggtatggagacattcattgaggacgaggataatattagatttactgtctacctaaatttcgttgaaccggaagaattgaatcttagtaagtttatgatggttcttccgggggcagccaacaagggaaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttacccttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatatttgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacttataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcattatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcgttgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacattgacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcaatttctatttttagatgtgatggaaaaatgactaattttgtagcattagtatcatgaactctaatcaaaatcttaatatcttcgtcacacgttagctctttgaagtttttaagagatgcatcagttggttctacagatggagtaggtgcaacaattttttgttctacacatgtatgtactggagccattgttttaactataatggtgcttgtatcgaaaaactttaatgcagatagcggaagctcttcgccgcgactttctacgtcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatgtcatataggaaactataaagtccgcactactgttaagaatgattactaacgcaactatatagtttaaattaagcattttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtataataactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgaaataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacgaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcattaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgcggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacgatatggatgccaacgtagtatcattttctactattgcgacgtatatagacgctttagcgaagaatgcttcggaattagaacagaggtctaccgcatacgaaataaataatgaattggaactagtatttattaagccgccattgattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttgttgcacgctattaatcatccaaagtcaaggcctaatacatctctggaaatagaattcacacctagagacaatgaaacagttccatatgatgaactaataaaggaattgacgactctctcgcgtcatatatttatggcttctccagagaatgtaattctttctccgcctattaacgcgcctataaaaacctttatgttgcctaaacaagatatagtaggtttggatctggaaaatctatatgccgtaactaagactgacggcattcctataactatcagagttacatcaaacgggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgctgacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatctcccagttctaaatgcattaaataattccaatagagcgatttttgttcctataggaccttccaactgtggatactctgtattgttaatagatatattaatacttttgtcgggtaacagaggttctacgtcttctaaaaataaaagttttataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagattaaaattaacaaaattaaaggagcatgtatttttttctgaatatattgtgactccagatacatatggatctttatgcgtcgaattaaatgggtctagttttcagcacggcggtagatatatagaggtggaggaatttatagatgctggaagacaagttagatggtgttctacatccaatcatatatctaaagatatacccgaagatatgcacactgataaatttgtcatttatgatatttatacgtttgattcgttcaagaataaacgattggtattcgtacaggtacctccgtcgttaggagatgatagtcatttgactaatccgttattgtcaccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatttactgggataagatttccaagttactgctgcagcatataactaaacacgttagtgttctttattgtttgggtaaaacagatttctcgaatatacgggccaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcggctattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggccattcaagattttattatcgaggtgtcaaactgtgtagctagattcgcgtttacagaatgcggcgccattcatgaaaatgtaataaaatccatgagatctaatttttcattgactaagtctacaaatagagataaaacaagttttcatattatctttttagatacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacaacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattttgtcaataagacatcaactacctaaggaatattcaagcgaattactctgtccaagaaaacgaaagactgtagaagctaacatacgagacatgttagtagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagctatatgaaaaaacattatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtttttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatatatatagatttgcatttctatacttgttggtgaaatggtacaaaaaatatcatgttcctattatgaaactatatcctacacccgaagagattcctgactttgcattctatctcaaaataggtactctgttggtatctagctctgtaaagcatattccattaatgacggacctctccaaaaagggatatatattgtacgataatgtggtcactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgccgaacatcaacatcttaaaaattttcaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgcggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggtagtcaattgatgtttttgttttcatcaaacattatgtccgaatcctatactctaaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagacgaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggatacctttccgttacattggaaccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgtcgactcataaaaaagagaatagcggtaagtataaacacgaatactatggcaataattgcgaatgttttattctcttcgatatatttttgataatatgaaaaacatgtctctctcaaatcggacaaccatctcataaaatagttctcgcgcgctggagaggtagttgccgctcgtataatctctccagaataatatacttgcgtgtcgtcgttcaatttatacggatttctatagttctctgttatataatgcggtttgccctcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggcggatctaatggaatccaattgattaactatcttttgaaaatatacatttttatgatccaatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatatgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcgttccaggcgatattatctcaacaaaattcagattctatctttagagtatccactaaactattacggtttatgtactacaatgaactaagagaaatctttagacggttgagaaaaggttctatcaacaatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactactgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaacttaaatgttacggccatagaggatgttattatgaatcattaaaaaaattaactgaggatgattgattaaaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatatacgaacatagtcctcctagtttggagactaattctttttcatcgactagacgtttattctcaaatagcgattggtgttgtaaggatcctggtcgtagtaagttaaccaacatggtgaattcttgcacactattgacgataggtgtagccgataaacaaatcatcttatggttttttaacgcaatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccgacacccgtttcatggaacaataaaagagaatgcatactgtctaatcctaagaaaactcttgctacaaaatgttgataatccttgaggcgtactacgtccgaccccatcatttcaacgggcatattagtagttctgcgtaaggcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgcgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctagagacagattaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattagccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctctacgatctcggcagactccggataaccagtcggtgggccatcgctaacaataactagatcatccaacaatctactcacatatgcatctatataatctttttcatcttgtgagtaccctggatacgaaataaatttattatccgtatttccataataaggtttagtataaacagagagagatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaactgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaataccctacttcaccacccttgtatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacgtactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacgtggaagtttgactttttttgtacctttgtacatttttgaaataccgactcgcaaaaaatacaatattcatatccttgttcagatactataccgttatgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatattgttaccgtcttccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcataatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatagcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcctcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgatcatttcctgcacgtttaggtttggtacgttgatttctagcccctgcggatataaagtcatcgtctacaatttgggacaatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatatccaatcttattacttttggaatcgttcaaaacctttgactagttgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgagaaagtgtaaccgttggagtagtacaagaaatacttccatccgattgttgtgtacatgtagttgttggtaacgtctgagaaggttgggtagatggcggcgtcgtcgttttttgatctttattaaatttagagataatatcctgaacagcattgctcggcgtcaacgctggaaggagtgaactcgccggcgcatcagtatcttcagacagccaatcaaaaagattagacatatcagatgatgtattagtttgttgtcgtggttttggtgtaggagcagtactactaggtagaagaataggagccgatgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcctctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcgttgatgtcgttattctgaaacagtatgattttaggtagcattttcttaacaaagagaacgtatttattgttactcagttgaacagatgatatatccagattactaacgcatctgattccgtataccaaactttcagaagaaatggtatacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatactatatcttcggtatcttgacgcagtctagtatacatagagttaagagagattagagtttgtacattaagcaacatgtctctaaatgtggctacaaacttttcctttttcacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtataaaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagccgtttattatcttgttccatattagcagtcattccatcatttaagaaggcgtcaaaaataatagggagaaatgacattttggattctgttacaactttaccaaaattaaggatatacggacttactatctttttctcaacgtcaatttgatgaacacacgatgaaaatgtgcttctatgagattgatcatgtagaaaacaacaagggatacaatatttccgcatatcatgaaatatattaagaaatcccaccttattatatttccccaaaggatccatgcacgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcgtacgatccaaattccggaatagatgtatcgcacgctctggccacccagataaccaaaaagtcacacgctccaggatatacattgtataaaaagctatcgttttttagtagggtttttttctgcgtgtatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggagaatagcggttttatatcccgcagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcattaacgagttaaaaaagaccagttcattcaagataagcaaacgcgataaggatacgctactaaaatattttacttaggactggagttagaatttatagacgactcatttcgtttatcattgttactattattactattactatcattattagtgttggcattattagtattcttcttgtcatcttgttcagaaatatacagcaatgctatacctaatactaaatacattatcatgctcgcaatggctctaacaacaacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatctccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattgcttcccataatggatcttctagtagtcaccttaaagcccattgatgcgaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcccgtctcagaaagtcctatatgcatgatagatttatctttcctgggaaactctcgtatagtcatagatgaaatactctttaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgttgtttctatttatgtccacaaattgcacgtttggaagcgccacggttacattcactgcagcattttgaggatcgcgagtatgaagtacgatgttattgtttactggtatatctggaaagaaatctaccagtctaggaataagagattgatatcgcatagaaatagtaaagtttataatctcatcatcgaagagcattttgttaccattgtaataaatatccactctgtcatatgtataaatgaagtactgttcaaacatgatgagatgtttatatgttggcatagtagtgagatcgacgtttggtaatggcaatgtattaagattaactccataatgtctagcagcatctgcgatgttataagcgtcgtcaaagcggggtcgatcttgtattgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacgtttcgtagagagttattaatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttagaggatgaagtggttaatcttagaaatcaacgatctaatacaaaatcatctgataatttagataattttaccaaaatactatttggtaagactccgtacaaatcaacagaagttaataagcgtatagccatcgttaattatgcaaatttgaacgggtcccccttatcagtcgaggacttggatgtttgttcggaggatgaaatagatagaatctataaaacgattaaacaatatcacgaaagtagaaaacgaaaaattatcgtcactaacgtgattattattgtcataaacattatcgagcaggcattgctaaaactcggatttgaagaaatcaaaggactgagtaccgatatcacttcagaaattatcgatgtggagatcggagatgactgcgatgctgtagcatctaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtgggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgaactctttgattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggattcggattttgtaagttcttgatcttattatacatcgagtataggatggcgacagtaactgctacacaaataccgatcaaaagaagaataccaatcatttattgacaataacttcactattgatcaagtatgcaatatatcatcttttcactaaataagtagtaataatgattcaacaatgtcgagatatatggacgataataatttagttcatggaaatatcgctatgattggtgtgaatgactccgctaactctgtggggtgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatgtccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgaccctacctgatgaatcggacaatgtactgggccatgtagaataaattatcaacgaattatcgtctacgaacatttatatcatttgttttaattttaggacgcgaataaatggatataaaatagaaaataacagatattacaaccagtgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttcgttgaacatcttgattataatataaccattttctatctctagattcgtcagtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcgtcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacagctgcccccattcttaataatcgtcagtatttaaactgttaaatgttggtatatcaacatctaccttatttcccgcagtataaggtttgttgcaggtatactgttcaggaatggttacatttatacttcttctatagtcctgtctttcgatgttcatcacatatgcaaagaacagaataaacaaaataatgtaagaaataatattaaatatctgtgaattcgtaaatacattgattgccataataattacagcagctacaatacacacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtattcgagacattaacaacgaccgataataaaatcactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaaccgaatttattgtaacagtattattaatattgccaagttatccaatctaaaaaaaactatctatgcagtagatagtttttttgagccatattccacagataatattagacatatggtaaaacgactagatggaccatctaataaatatcatatatataccgagaagttattatctgtagacgagcctagaaatcaacttattcttgataccctggtagaagaattcaagtcaggaactattaatcgcattttagttattactaaactacgtgaacatatggtattattctacaaacgattattagattttttcggaccagaggttgtatttataggagacgcccaaaatagacgtactccagatatggtcaaatcaatcaaggaactaaatagatttatattcgtatccaccttattttattccggtactggtttagatattcctagtttggattcgttgttcatttgctcggcagtaatcaacaatatgcaaatagagcaattactagggagggtatgtcgagaaacagaactattagataggacggtatatgtatttcctaacacatccatcaaagaaataaagtacatgataggaaatttcatgcaacgaattattagtctgtctgtagataaactaggatttaaacaaaaaagttatcggaaacatcaagaatccgatcccacttctgcatgtacaacatcatccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcgactcttcattccggaacgcacattggtgctatccatttaggtagtaaaaaataagtcagaatatgccctataacacgatcgtgcaaaacctggtatatcgtctctatctttatcacaatatagtgtatcgacatttttattattattgacctcgtttatcttggaacatggaatgggaacatttttgttatcaacggccatctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgagattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttagacggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgaaactatatatggaaactttaaccagttcgtctcaatctttaatgtcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcgcatagctaaagatttgtcacaatatgaatacactacagttcttctagaacgtcagcctagaaggtcgccgtatgttaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcctgccattaagaaactagtgtattgcgacatccaacttactaaacacattattaatcagaatacgtatccggtatttaacgattcttcacaagtgaaatgttgtcattatttcgacataaactcagataatagcaatattagctctcgtacagtagagatatttgagagggaaaagtcatctcttgtatcatatattaaaactaccaataagaagagaaaggtcaattacggcgaaataaagaaaactgttcatggaggcactaatgcaaattacttttccggtaaaaagtctgacgagtatctgagtactacagttagatccaacattaatcaaccttggatcaaaaccatctctaagaggatgagagttgatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaagatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaacactaattcagaaatggatcaacgactagggtataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatcttccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcccggacttaatcacgcgttttctagcttattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcagacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcattagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccattggaaaactttaataacaaagaaagagataggtctaacgcctattcaaaattagaaagtaatggattagttagactgaatgctttcttggaatccggagacgctatggcacgaaatatctcatcaagaactcttgaagatgattttgctagagataatcagattagcttcgatgtttccgagaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatgtcgcggatgaaacggaacttccatacgacgaaaatggtatcacaccagatgtcattattaattctacatccatcttctctagaaaaactatatctatgttgatagaagttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtccgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagtcaaattagatttcgaacgaaggcctccttcgttttataaaccattagataaagttgatctcaagccgtcttttctggtgtaatattctagtttggtagtagatacatatcaatatcatcaaattcgagatccgaattataaaatgggcgtggattgttaactatagaatcggacgtctgatattcgaaaatctgtggagtttcaggttttggtggaggtgtaactgctacttgggatactgaagtctgatattcagaaagctgtggatgttctggttcggcatccaccgatggtgtcacatcactaatcggttcggtaacgtctgtggatggaggtgctacttctacagaacctgtagcctcagttgtcaacggagatacatttttaatgcgagaaaatgtataatttggtaatggtttcttatgtggatctgaagaagaggtaagatatctactagaaagataccgatcacgttctagttctcttttgtagaacttaactttttctttctccgcatctagttgatattccaacctcttcacgttactacgttcagattccaattcacgttcgcatgggttacctccgcagtttttacgagcgatttcacgttcagccttcatgcgtctctccctctctctatcgagtttatcagagcagtctttctgaaggcgatcgaactccataaatttctccaacgctttgattgtttccatagatttccgaagttcagcttttaggactgtgattctttttctttcgaattcacagctggatgtacaaccgtttccattaccgccatctctaagtttcttttctagatcggcaacatttcatccccatgccttttacattcctcgagtctactgtcgtcgaaatatcgttccagctccttttcgacatcaataactttagcacgttgtctctcaagctctcttttgtagttatctgattccctggcacgtttaagatcttcatgcaattgagtcagctcttaacttcctctcttgcttcttcgtcatagtacgcgcaatcactgtgagatccattgttaccacgtctacactcggcgagctcgcgtttaagagattcaatttcccgtttgtattggtccatgtttccattgctaccaccattagatttacaggctgctagttgtcgttcgagatcagaaatacgggttttcttggaattgatttcgtcgatgtacttggcatcgaaacacttattaagttctttttccaattctacgattttatttctttcgcgagtcaattccctcctgtagtaactatctgttttgtcagattcacgctctctacgtagactttcttgcaagttactaatttgttccctagcacgtccgagtttagttttatatgctgaatagagttctgattcatcctttgagcagatctctagcgatcgtttaagattcctaattctagtctttagcctatttacctcctcagaagatgttccgttaccgttgcgtttacactcgttaagctgtctatcaagatccatgattctatctctaagacgttgcatctctctttccatatcagcattgctttcattattacgtctgcagtcactcaactgtctttcaatatctgagattctatctctaagacgtcgcatctctctctgtttcggcattggtttcattattacgtttacagtcgttcaactgtctttcaagatctgatattctagattggagtctgctaatctctgtagcattttcacggcattcactcagttgtctttcaagatctgaaattttagattggagtctgctaatctctgtaagatttcctcctccgctctcgatgcagtcggtcaacttattctctagttctctaatacgcgaacgcagtgcatcaacttcttgcgtgtcttcctggttgcgtgtacattcatcgagatctctaacgcgtcgtcgttcttcctcaagttctctgcgtactacagaaagcgtgtccctatcttgttgatatttagcaatttctgattctagagtactgattttgcttacgtagttactaatagttgtcttggccttatcaagatcctccttgtatttgtcgcattccttgatatccctacgaagtctggacagttcccattcgacattacgacgtttatcgatttcagctcggagatcgtcatcgcgttgttttagccacatacgactgagttcaagttctcgttgacaagatccatctacttttccattcctaatagtatccagttccttttctagttctgaacgcatttctcgttccctatcaagcgattctctcaattctcggatagtcttcttatcaatttctaataaatctgaaccatcatctgtcccattttgaatatccctgtgttctttgatctcttttgtaagtcggtcgattctttcggttttataaacagaatccctttccaaagtcctaatcttactgagtttatcactaagttctgcattcaattcggtgagttttctcttggcttcttccaactctgttttaaactctccactatttccgcattcttcctcgcatttatctaaccattcaattagtttattaataactagttggtaatcagcgattcctatagccgttcttgtaattgtgggaacataattaggatcttctaatggattgtatggcttgatagcatcatctttatcattattagggggatggacaaccttaattggttggtcctcatctcctccagtagcgtgtggttcttcaataccagtgttagtaataggcttaggcaaatgcttgtcgtacgcgggcacttcctcatccatcaagtatttataatcgggttctacttcagaatattcttttctaagagacgcgacttcgggagttagtagaagaactctgtttctgtatctatcaacgctggaatcaatactcaagttaaggatagcgaatacctcatcgtcatcatccgtatcttctgaaacaccatcatatgacatttcatgaagtctaacgtattgataaatagaatcagatttagtattaaacagatccttaacctttttagtaaacgcatatgtatattttagatctccagatttcataatatgatcacatgccttaaatgtcagtgcttccatgatataatctggaacactaatgggtgacgaaaaagatacagcaccatatgctacgttgataaataaatctgaaccactaagtagataatgattaatgttaagaaagaggaaatattcagtgtataggtatgtcttggcgtcatatcttgtactaaacacgctaaacagtttgttaatgtgatcaatttccaatagattaattagagcagcgggaataccaacaaacatattaccacatccgtattttctatgaatatcacatatcatgttaaaaaatcttgatagaagagcgaatatctcgtctgacttaatgagtcgtagttcagcagcaacataagtcataactgtaaatagaacatactttcctgtagtgttgattctagactccacatcaacaccattattaaaaatagttttatatacatctttaatctgctctccgttaatcgtcgaacgttctagtatacggaaacactttgatttcttatctgtagttaatgacttagtgatatcacgaagaatattacgaattacatttcttgtttttcttgagagacctgattcagaactcaactcatcgttccatagtttttctacctcagtggcgaaatctttggagtgcttggtacatttttcaataaggttcgtgacctccatttattataaaaaatttattcaaaacttaactacaatcgggtaattataagatcgtagatctcccatgtggcggaatactaccatctatcgcatgtggatggacagtaggtaatggccatgggaacagtaatgtttgcatatttatctttcttgctagtattactgcatattgtcccaatgtttcgatgtgatgttctaacctatcaactgccgctgtatcacaacaatagtgtccgatgaaattaagattatgatccaatgtgtttaatatatgattatcaagtcttatacgatccgcgtcttttttgacaggatcaggttcttctacaggaagaagtttcggcctcttatgatattcatgtctgggaaacggtggtctagggtgaggctccggtatcggagtgggttttggattataatcatcatcgtctatgacatcatcttcgacttcgatatttattttgctatcttgatgatgtcctgtatcagttgcattttcagcactcgactgaatattagcgcattcattgtctattattaccatatttctaaacccaaaatgtatgtgttgaacatcagtactatcgttgatgagtcttatagcatgaattcgcttatcgttatcgggtttatcttctgtcaccttagcaattccttttttattaaactctacataatcatatccatttctattgtttgttctaatataaacgagtatagcatcattgctaaatttttcaatagtatcaaaaacagaatatcctaaaccatataatatatattcaggaacactcaaactaaatgtccaggattctcctaaatacgtaaactttaatagtgcgaaatcattcaaaaatctaccacttatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgcttattaataagatttttatcattgctcgttatttcagaatcgtatatataaggagtaccatcgtgattcttaccagatattatacaaaatactatatataaaatatattgacccacgttagtaatcatataaatgtttaacgttttaaattttgtattcaatgatccattatcatacgctatcatggtcttgtaatattcattctttaaaatataatattgtgttagccattgcattggagctcctaatggagattttctattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagcctttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtcgctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgtgatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaataatctaaagatgatgctattttacatggatttatcatatcatggagtgacaagtagtggagcaatttacaaattgggatcgtctatcgatagactttctctaaataggactattgttacaaaagttaataattatgatgatacattttttgacgacgatgattgatcgctattgcacaattttgtttttgtactttctaatatagtgtttaggttctttttcatatgagaatattgatttactaaaatatctatgtttaacttttgttctatgacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgatatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctgggttataaacgggtgtaaacaagaatatatgtttatattttttaactagtgtagaaaacagagatagtaaatagatagtttttccagatccagatcctcctgttaaaaccattctaaacggcatttttaataaattttctcttgaaaattgtttttcttggaaacaattcataattatatttacagttactaaattaatttgataataaatcaaaatatggaaaactaaggttgttagtagggaggagaacaaagaaggcacatcgtgatataaataacatttattatcatgatgacaccagaaaacgacgaagagcagacatctgtgttctccgctactgtttacggagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttgaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggccgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagctagattgcctagacctgatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtaattaatgaaacggagactgttgaagtacttaatgaagataccaaacagaatcctaactattcatccaatcctttcgtaaattataataaaaccagtatttgtagcaagtcaaatccgtttattacagaacttaacaataaatttagtgagaataatccgtttagacgagcacatagcgatgattatcttaataagcaagaacaagatcatgaacacgatgatatagaatcatcggtcgtatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacatcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactatatgtaaacaatctgtcactgattaattatttgccgttgtctgtattcattattagacgagtcaccgactatttggatagacacatatgcgatcagatatttgctaataataagtggtattcccttataaccatcgacgataagcaatatcctattccatcaaactgtataggtatgtcctctgccaagtacataaattctagcatcgagcaagatactttaatccatgtttgtaacctcgagcatccgttcgactcagtatacaaaaaaatgcagtcgtacaattctctacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgatagaaagaataagaataagatcaaggattatatggaacacgattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagttccatcaacacattcctttaaactcaatcccaaacccaaaaccgttaaaatgtatccggccaattgatagtagataatgaggtgtacagcgcatgataatttacacagtaaccaaaatgaaaatactttagtaattataagaaatatagacggtaatgtcatcatcaacaatccgataatatgcctgagagtaaacattgacggataaaacaaaaatgctccgcataactctatcatggcaataacacaaccaaatacttgtaagattcctaaattagtagaaaatacaacgaatatcgatgtataagtgatctcgagaaataataagaataaagtaatgcccgtaaagataaacatcaacattgtttggtaatcattaaaccaattagtatgaagttgaactaatttcacagtagattttattccagtgttatcctcgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggataaggatacattagtatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttattcacggcggataacgtaattccaaaagatggtttacgaggagcattcgtcgataaagacggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaacaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaactgcgaaaccgttatttatagcagatatagggataggagtaggaatgccacaaatgaaaaaaatacttaaaatgtaatcttaatcgagtacaccacacgacaatgaacaaacataagacagattatgctggttatgcttgctgcgtaatatgcggtctaattgtcggaattatttttacagcgacactattaaaagttgtagaacgtaaattagttcatacaccattaatagataaaacgataaaagatgcatatattagagaagattgtcctactgactggataagctataataataaatgtatccatttatctactgatcgaaaaacctgggaggaaggacgtaatgcatgcaaagctctaaattcaaattcggatctaattaagatagagactccaaacgagttaagttttttaagaagccttagacgaggctattgggtaggagaatccgaaatattaaaccagacaaccccatataattttatagctaagaatgccacgaagaatggaactaaaaaacggaaatatatttgtagcacaacgaatactcccaaactgcattcgtgttacactatataacaattacactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccacactcatcgtatattttgacgtatgtagtcacatcgtttacgcaatagtcagactgtagttctatcatgcttcctacatcagaaggaggaacagttttaaagtctcttggttttaatctattaccgttagttttcatgaaatcctttgttttatccacttcacattttaaataaatgtccactatacattcttttgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttgtaataagaataaaatgctaatgtcaagtttattccaatagatgtcttattaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatccgggtgaaattattcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacaagtataatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcgtaatacgatctataaaaataagtatataaatactttttatttactgtactcttactgtgtagtggtgataccctactcgattatttttttaaaaaaaaaatacttattctgattcttctagccatttccgtgttcgtttgaatgccacatcgacgtcaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatcttagatcccggatactggatatattttgcagccaacacgtgcatccatgcagcatttcctacatatacccggctatgcaccgcgtcatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaaaatagtctgtgttccataatagtttactttcatgatttcattatcggtgtattttccaaatacatccactagagcagccgtatgaataatcagatttaccccatctagcgcttctctcaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttttaggatcagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatttacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgacaccatagagataagaggggtgcttccagaggaaactaatattggttgcgcggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcggacacactgagagcatagaggataaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaataaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggaatattccaagagttttagttgtctagtatttaacaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagaagatgatttctgaattatttcatatatctctctctttaactccaggaacttgtcaggatggtctactttaatatgttctcgtctaagagatgaaaatctttggatggttgcacgcgacttttctctaaaggatgacgttgcccaagatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacgaaaatgtctcgtggggcattaatcgtttttgaaggattggacaaatctggaaaaacaacacaatgtatgaacatcatggaatcaataccttcaaacacaataaaataccttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattttctggagtagcgtatgccgccgctaaaggcgcgtcaatgactctcagtaagagttatgaatctggattgcctaaacccgacttagttatattcttggaatctggtagcaaagaaattaatagaaacgtcggtgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatagatgttagtacagtgttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagaactatcagactgagttgattaattcattagacgacaatgaaattatcgattgtatagttaataagtttatgagcttttataaggataacctagaaaatatagtagatgctatcattactctaaaatatataatgaataatccagattttaaaactacgtatgccgaagtactcggttccagaatagccgatatagatattaaacaagtgatacgtaagaatatactacaattgtctaataatatccgcgaacgatatttgtgaaaatattaaaaaaaaatactttttttattaaatgacgtcttttcgtgaatttagaaaattatgctgtgctatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatgtagcatctgtttgtacatgtaatgatttaaaatgtgtagtcatgcttattgataaagatctaaaaattaaagcgggtcctcggtacgtacttaacgctattagtcctaatgcctatgatgtgtttagaaaatctaataacttgaaagagataatagaaaattcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcctactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccgaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaactgaaaattaaaataacactatttagttggtggtcgccatggatggtgttattgtatactgtctaaacgcgctagtaaaacatggcgaggaaataaatcatataaaaaatgatttcatgattaaaccatgttgtgaaagagtttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttatcatatctataggaaaggataaagatgtctgtgaactattaatctcatcagacatatcgtgtgcatgcgtggagttaaattcatatcacgtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcgatagctgataatagaactcacgcaattattagcaaaaatatattagacaatactacgattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaatttaataagaaatcgagactacattcccgggagacgaggatatagctactacgtttacggtatagcctctagataatttttttaagcacgaaataaaaaacataattttaaaccaatctatttcatactattttgtgtgatcaccatggacataaagatagatattagtatttctggtgataaatttacggtgactactaggagggaaaatgaagaaagaaaaaaatatctacctctccaaaaagaaaaaactactgatgttatcaaacctgattatcttgagtacgatgacttgttagatagagatgagatgtttactattctagaggaatattttatgtacagaggtctattaggcctcagaataaaatatggacgactctttaacgaaattaaaaaattcgacaatgatgcggaagaacaattcggtactatagaagaactcaagcagaaacttagattaaattctgaagagggagcagataactttatagattatataaaggtacaaaaacaggatatcgtcaaacttactgtatacgattgcatatctatgataggattgtgtgcatgcgtggtagatgtttggagaaatgagaaactgttttctagatggaaatattgtttacgagcgattaaactgtttattgatgatcacatgcttgataagataaaatctatactgcagaatagactagtatatgtggaaatgtcatagaaagttaaaagttaatgagagcaaaaatatataaggttgtattccatatttgttatttttttctgtaatagttagaaaaatacattcgatggtctatctatcagattattatgtgttataaggtactttttctcataataaactagagtatgagtaagatagtgtttttcaaaacatataaatctaaaattgatggatgagatatacagctattaatttcgaaaatatattttaatctgataactttaaacatggatttttaatggtggtttaacgttttaaaaaaagattttgttattgtagtatatgataatattaaaagatggatataaagaatttgctgactgcatgtactattttttacattactacattggctacggcagatatacctacttcgtcactgccacacgctccggtaaacggggcatgtgacgagggagaatatcttgataagaggcataatcaatgttgtaatcagtgtccacctggagaatttgccaaggttagatgtaatggtaacgataacacaaaatgtgaacgctgcccacctcatacatataccgcaatccccaattactctaatggatgtcatcaatgtagaaaatgcccaacaggatcatttgataaggtaaagtgtaccggaacacagaacagtaaatgttcgtgtcttcctggttggtattgcgctactgattcttcacagactgaagattgtcgagattgtataccaaaaaggagatgtccatgcggatactttggtggaatagatgaacaaggaaatcctatttgtaaatcgtgttgtgttggtgaatattgcgactacctacgtaattatagacttgatccatttcctccatgcaaactatctaaatgtaattaattatgattttgatgataatgttaccatacattatatcgctacttggttagtgtattattcagtatgaagacctattaataattacttatcttttgacgatcttgttataattataatataaaaatacttatggcatagtaactcataattgctgacgcgataaattcgtaataatctgttttgttcaaatttttataaggaatctacaggcataaaaataaaaatataatttataatatactcttacagcgcgccatcatgaataacagcagtgaattgattgctgttattaatggatttagaaatagtggacgattttgtgatattaatatagttattaatgatgaaaggataaacgctcacagactcatcctatctggagcctccgaatatttttccattctgttttccaataattttatcgattctaatgaatacgaagttaatctaagtcatttagattatcaaagtgttaacgatttgatcgattacatttatgggatacctttgagcctaactaacgataacgtgaaatatattctttcaaccgctgattttttacaaattggatctgctattacggagtgtgaaaattacatacttaaaaatctttgttctagaaactgtatcgatttctacatatacgctgataaatataataacaagaaaatagaatcagcgtcgtttaacacaatattacaaaatattttgagactcatcaacgatgaaaactttaaatacttaacagaggaatcaatgataaaaattttaagcgatgatatgttaaatataaaaaatgaggatttcgccccactaattctcattaaatggttagagagtactcaacaaccatgcaccgtcgagttacttaaatgcctcagaatatcattgctttccccacaagttataaaatcactttatagtcatcgactggttagttcaatctacgaatgtataacattcttaaacaatatagcattcttggatgaatcatttcctagataccatagcatcgagttgatatctatcggtataagtaattcgcatgataagatttccataaactgctacaatcataaaaaaaatacatgggaaatgatatcttcacgtagatataggtgtagtttcgcagtggccgtcctggataatattatctatatgatgggtggatatgatcagtccccgtatagaagttcaaaggttatagcgtacaatacatgtacaaattcttggatatatgatataccagagctaaaatatcctcgttctaattgtgggggactggctgatgacgaatacatttattgtataggcggcatacgcgatcaggattcatcgttgacatctagtattgatagatggaagccatcaaaaccatattggcagaagtatgctaaaatgcgcgaaccaaaatgtgatatgggggttgcgatgttaaacggattaatatatgttataggtggaatcgttaaaggtgacacgtgtaccgacgcactagagagtttatcagaagatggatggatgaagcatcaacgtcttccaataaaaatgtccaatatgtcgacgattgttcatgatggcaagatttatatatctggaggttacaacaatagtagtgtagttaatgtaatatcgaatctagtccttagctataattcgatatatgatgaatggaccaaattatcatcattaaacattcctagaattaatcccgctctatggtcagcgcataataaattatatgtaggaggaggaatatctgatgatgttcgaactaatacatctgaaacatacgacaaagaaaaagattgttggacattggataatggtcacgtgttaccacgcaattatataatgtataaatgcgaaccgattaaacataaatatccattggaaaaaacacagtacacgaatgattttctaaagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaaactttctagaacatactgagtttttaggaaatatttacggaacttctaaaactgctgtgaatacagcggctattaataatcgtatttgtgtgatggatctaaacatcgatggcgttagaagtcttaaaaatacgtacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtgtctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggattcggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagactaccaaaaaggtcggtgatgttgatcggaatcgaaatcttaaataccatacaatttatgcacgagcaaggatattctcacggagatattaaagcgagtaatatagtcttagatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttaccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggaaatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgagtgcacttagtccaggacctatcatcgattaccacgtctggataggagattgtatctgtcaagttactgctgtggacgtacatggaaaggaaattatgaaaatgagattcaaaaagggtgcggtgcttccgatcccaaatctggtaaaagttaaacttggggagaatgatacagaaaatctttcttctactatatcggcggcaccatcgaggtaaccacctctctggaagacagcgtgaatcatgtactcatgaaacgtttggaaactatacgccatatgtggtctgttgtatatgatcattttgatattgtgaatggtaaagaatgctgttatgtgcatacgcattcatctaatcaaaatcctataccgagtactgtaaaaacaaatttgtacatgaagactatgggatcatgcattcaaatggattccatggaagctctagagtatcttagcgaactgaaggaatcaggtggatggagtcccagaccagaaatgcaggaatttgaatatccagatggagtggaagacactgaatcaattgagagattggcagaggagttcttcaatagatcagaacttcaggctggtgaatcagtcaaatttggtaattctattaattgttaaacatacatctgtttcagctaagcaactaagaacacgtatacggcagcagcttccttctatactctcatcttttaccaacacaaagggtggatatttgttcattggagttgataataatacacacaaagtatttggattcacggtgggttacgactacctcagactgatagagaatgatatagaaaagcatatcaaaagacttcgtgttgtgcatttctgtgagaagaaagaggacatcaagtacgcgtgtcgattcatcaaggtatataaacctggggatgagactacctcgacatacgtgtgcgctatcaaagtggaaagatgctgttgtgctgtgtttgcagattggccagaatcatggtatatggatactaatggtatcaagaagtattctccagatgaatgggtgtcacatataaaattttaattaatgtaactatagagaacaaataataaggttgtaatatcatatagacaataactaacaattaattagtaactgttatctcttttttaactaaccaactaactatatacctattaatacatcgtaattatagttcttaacatctattaatcattaattcgcttctttaattttttataaactaacattgttaattgaaaagggataacatgttacagaatataaattatatatggatttttttaaaaaggaaatacttgactggagtatatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcgggttatcatcatccattaatataaaagaatatgtatatcaattagttaataatgatcatccagataataggataagactaatgcttgaaaatggacgtagaacaagacattttttgtcctatatatcagatacagttaatatctatatatgtattttaataaatcatggattttatatagatgccgaagacagttacggttgtacattattacatagatgtatatatcactataagaaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatatacaacgaaacatctatttacgacgctgtcagttataatgcgtataatacgttggtctatctattaaacaaaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacagtcgctacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaaatgcactagtctcgacgtatacggaagtcgtgtacgtaatatcatagcatctattagatatcgtcagagattaattagtctattatccaagaagctggatcctggagataaatggtcgtgttttcctaacgaaataaaatataaaatattggaaaactttaacgataacgaactatccacatatctaaaaatcttataaacattattaaaatataaaatctaagtaggataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaatgataaccagaaagttacgtttacatgtgatcagggatatcattctttggatccaaatgctgtctgtgaaacagataaatggaaatacgaaaatccatgcaaaaaaatgtgcacagtttctgattatgtctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaacggattaatttccggatctacattttctatcggtggcgttatacatcttagttgtaaaagtggttttacactaacggggtctccatcatccacatgtatcgacggtaaatggaatcccatactcccaatatgtgtacgaactaacgaaaaatttgatccagtggatgatggtcccgacgatgagacagatttgagcaaactctcgaaagacgttgtacaatatgaacaagaaatagaatcgttagaagcaacttatcatataatcatagtggcgttgacaattatgggcgtcatatttttaatctccgttatagtattagtttgttcctgtgacaaaaataatgaccaatataagttccataaattgctaccgtaaatataaatccgttaaaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtataccattgactcgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacatgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggactatgcgtcgaagtaaaaattggaccaccgactgtaacattgactgaatacgacgaccatatcaatttgtacatcgagcatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaatacacagtctcaatcttatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggattgataactgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcattgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtgcatggaagttagtacatgatcgtctccccgctataaaggcattatcaacttctccttattgattgaaaatgaaaatataaatagtttttatgtatagcagtattaccctatagttttattgcttactactaacatggatacagatgttacaaatgtagaagatatcataaatgaaatagatagagagaaagaagaaatactaaaaaatgtagaaattgaaaataataaaaacattaacaagaatcatcccaatgaatatattagagaagcactcgttattaataccagtagtaatagtgattccattgataaagaagttatagaatgtatcagtcacgatgtaggaatatagatcatatctactaatttttataatcgatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaattcgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaagacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtaaactgtttatacaagattgaaattatattcttttttttatagagtgtggtagtgttacggatatctaatattaatattagactatctctatcgcgctacacgaccaatatcgattactatggatatcttctatgaaaggagagaatgtatttatttctccagcgtcaatctcgtcagtattgacaatactgtattatggagctaatggatccactgctgaacagctatcaaaatatgtagaaacggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaaccattgtctcctagcaattagtgccgtatactttaaagcaaaatggttgacgccattcgaaaaggaatttaccagtgattatcccttttacgtatctccgacggaaatggtagacgtaagtatgatgtctatgtacggcaaggcatttaatcacgcatctgtaaaagaatcattcggcaacttttcaatcatagaactgccatatgttggagatactagtatgatggtcattcttccagacaagattgatggattagaatccatagaacaaaatctaacagatacaaattttaagaaatggtgtgactttatggatgctatgtttatagatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttctgtactagtggcagactgtgcatcaacaattacaaatgagttctgtgcagatcatccgttcatctatgtgattaggcatgttgatggaaaaattcttttcgttggtagatattgctctccgacaactaattgttaaccattttttttaaaaaaaatagaaaaaacatgtggtattagtgcaggtcgttgttcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtacagaaatcatccgttgttatataccggatgagcaaaaaaccatcagagagatttcggccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttctttcttctcttctccctttcttctcttctcccttcctccctcttctccctttcccagaaacaaacttttttacccactataaaataaaatgagtatactacctattatatttcttcctatatttttttattcttcattcgttcagacttttaacgcgtctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcggacatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggatagaataataccttctactatgcaattaccagatggcattgtaacttcaataggtagtaatttgactattgcatgcagagtatcgttgagacctcccacaacggacaccgacgtcttttggataagtaatggtatgtattacgaagaagatgatggggacggaaacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcgtgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttagtatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaaccgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcaaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatgacgtaaatgtaacgatgaaaaccagtagcggacgtatgcctgtttatatattgcttactagatgttgtaatatttcacatgatgtagtgatagatatgatagacaaagataaaaaccacttattacatagagactattccaacctattactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaactaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtatgatcgtattcgagtttatcaaaacatattctacacgtccggcagattcgataacttatttgatgaataggtttaaaaatataaatatttatacccgctatgaaggaaagacattattacacgtagcatgtgaatataataatacacaagtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacgataggcacgttaagaatcgcgattctaaaacgtatcgatacgcattttcaaaatacatgtcgtttgataaatacgatggtataataactaaatgtcacgacgaaacaatgttactcaaactgtccactgttctagacactacactatatgcagttttaagatgtcataattcgagaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataataaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaagaatagacggcgacaggtttctaataaacgtgttaaacatggtgatttatggatagccaactatacatctaaattcagtaaccgtaggtatttgtgcaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgacattaagtattcacaaacgggaaaggaattaattattcataatccagagttagaagatagcggaagatacgactgttacgttcattacgacgacgttagaatcaagaatgatatcgtagtatcaagatgtaaaatacttacggttataccgtcacaagaccacaggtttaaactaatactagatccgaaaatcaacgtaacgataggagaacctgccaatataacatgcactgctgtgtcaacgtcattattgatcgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatatacaatgcatttttatatacattactgaattattattactgaattattattactgaattattattaattatatcgtatttgtgctatagaatggatgaagatacgcgactatctaggtatttgtatctcaccgatagagaacatataaatgtagactctattaaacagttgtgtaaaatatcagatcctaatgcatgttatagatgtggatgtacggctttacatgagtacttttataattatagatcagtcaacggaaaatacaagtatagatacaacggttactatcaatattattcatctagcgattatgaaaattataatgaatattattatgatagaactggtatgaacagtgagagtgataatatatcaatcaaaacagaatatgaattctatgatgaaacacaagatcaaagtacacaactagtaggttacgacattaaactcaaaaccaatgaggatgattttatggctatgatagatcagtgggtgtccatgattatatagatgaatcaattaataaagtagtatatggaagagagtctcacgtaagatggcgggatatatggcaagaacataatgatggcgtatacagtataggaaaggagtgcatagataatatatacgaagacaaccataccgtagacgaattctacaagatagacagcgtatcagatgtagatgacgcggaacacatatctccgataactaaaaaaccatagaatcagttgatgataatacctacatttctaatcttccgtataccatcaaatacaaaatattcgagcaacaataagtattttttatacctttaaaactgataaataaattttttctagtgatattttggcaagatgagaatcctatttctcatcgctttcatgtatgggtgtgttcactcatatgttaacgcggttgaaaccaaatgtccaaatctagacattgtaacatcttctggagaatttcattgttcaggatgtgtggaacatatgcctgagtttagctatatgtattggttggcaaaggatatgaaatcggacgaggataccaagtttatagaacatctgggtgatggcatcaaagaagatgaaaccgttcgtaccacagatagtggaatcgtcactctacgtaaagtccttcatgtgactgatactaataaatttgataattataggttcacttgtgtcctcgctacgctagatggcatttataaaaagaatgtttgctgaagtagttgtgtgctactatttttatttatgatataatctaatggaattaatttgaattgatatttatccaatactaaagattatattagaatcaaattaatcttttatacgagaaaaaataacgacatacgtcgtcaacaaattaaactttttatttattagttaactagcttatagaacttgctcattgttatgtttctaaaacgggtacggcatataggacaattatccgacgcaccggtttctcttcgtgttctatgccatatattgatgcatgttatgcaaaatatatgagtacacgaatccaataaaccaaagtatctatcgttttgagtaaacaacttcatagcaaattccacattctttttctttacttactctatacacgtcctcgtatttatttagtattttgatgatatccaactcagaaatggttgttgtattattgggtgtatttggagtataggtattattagctatgtaccaatttaccaaccctcttaatattgattgataatcacatcggttatccaattaataactaaattgtagtgtatatatagaccatatatgtttctatttttttgacagttacgtatagtttcagtaagttttgattgttgtattcctgtatctctagataagttagtcatatagtcccttccggcgatacgttttttccaagcccgaaattgattagccaaatgtgtatttatttttgtgatattgatataatatttcggataatgcatactgttagtcttatatcatttggttcatctatgtattgtaatattgttacatgatctatagatgatgtattgattttggcaggatcgaattccatatccgcgactaaacagtgaaaaaaatgtaaatactttttaaattttaaattagtaaaacttttttttattttttatgattccaaaaatactgaatacaaagtcctaaattataaatatggagatcatactaccacaacttattattatgtatacaaggccggtgtaatagatagatatatataattctattacaccggcagacaattaccgaccggtatttgtcgttaccaacataccgtataatatgtaatatacaattccataacccattgacagttgttatacatcaaaattgcaattcttttgattacgatgttataagaatgtagttaattgatgtatgatgttaatgtgtcctctttcctcttataacatcgtaatcaaaaacttttttataatatatacctaataatgtgtcttaatagttctcgtgattcgtcaaacaatcattcttataaaatataataaagcaacgtaaaaacacataaaaataagcgtaactaataagacaatggatatttacgacgataaaggtctacagactattaaactgtttaataatgaatttgattgtataaggaatgacatcagagaattatttaaacatgtaactgattccgatagtatacaacttccgatggaagacaattctgatattatagaaaatatcagaaaaatactatatagacgattaaaaaatgtagaatgtgttgacatcgataacacaataacttttatgaaatacgatccaaatgatgataataagcgtacgtgttctaattgggtacccttaactaataactatatggaatattgtctagtaatatatttggaaacaccgatatgtggaggcaaaataaaattataccaccctacaggaaatataaagtcggataaggatattatgtttgcaaagactctagactttaaatcaacgaaagtgttaactggacgtaaaacaattgccgttctagacatatccgtttcatataatagatcaatgactactattcactacaacgacgacgttgatatagatatacatactgataaaaatggaaaagagttatgttattgttatataacaatagatgatcattacttggttgatgtggaaactataggagttatagtcaatagatctggaaaatgtctgttagtaaataaccatctaggtataggtatcgttaaagataaacgtataagcgatagttttggagatgtatgtatggatacaatatttgacttttctgaagcacgagagttattttcattaactaatgatgataacaggaatatagcatgggacactgataaactagacgatgatacagatatatggactcccgtcacagaagatgattacaaatttctttctagactagtattgtatgcaaaatctcaatcggatactgtatttgactattatgttcttactggtgatacggaaccacccactgtattcattttcaaggtaactagattttactttaatatgccgaaataaaaaatttttgtataatatctagaggtagaggtattgtttagataaatacaaataacatagatacatcgcatacttagcatttttataaatatacataagacatacactttatacatttttgtaaaaatactcataaaaaaatttataaaaattatggcacaaccatatcttgtataggtagtttagttcgtcgagtgaacctataaacagataatagacaacacataataatgcctactaatacaagcataataccgggagatgggatatatgacgttgtagtgtttgggttttctgaacgttgatagtctactaatactacatgctgacatctaatgcctgtataaccatgagagcatctacaatacataccgtcaatatctctagcgtggatacagtcaccgtgtaaacaatatccatctccctctggaccgcataatctgatagctggaatatctgttgtagcgtttgtaatttctggcaatgtcgtttcgatagcgttaccactatcggcgaatgatctgattatcatagcagcgaacaacaacatcagataatttatcaacatttttgatggattctgtgtttatgctgtttctcagtgtgtgtttatgacaagattgggaattttatattattaattcagtaatataaactaataatatattgttaattgtgtaaataatataaaaataacaatacaatattgaatgtgttgctgttaaaaatgtatgtgttaatataatagaataaaataaatgagtatgatcattttagataacgattgattttatcattaccgcttcattcttatattctttgcttacggaacctatatttagaaacatctactaacaattttttatgcttgcattattaatggtatgtaatatgattgattgtgtacgcaataccaatttgttaagtatgaatacggggtacaaacataaattgaaatttaacattatttatttatgatatatatcgttatcgttaggtctataccatggatatctttaaagaactaatcttaaaacaccctgatgaaaatgttttgatttctccagtttccattttatctactttatctattctaaatcatggagcagctggttctacagctgaacaactatcaaaatatatagagaatatgaatgagaatacacccgatgacaataatgatgacatggaggtagatattccgtattgtgcgacactagctaccgcaaataaaatatacggtagcgatagtatcgagttccacgcctccttcctacaaaaaataaaagacgattttcaaactgtaaactttaataatgctaaccaaacaaaggaactaatcaacgaatgggttaagacaatgacaaatggtaaaattaattccttattgactagtccgctatccattaatactcgtatgacagttgttagcgccgtccattttaaagcaatgtggaaatatccattttctaaacatcttacatatacagacaagttttatatttctaagaatatagttaccagcgttgatatgatggtgggtaccgagaataacttgcaatatgtacatattaatgaattattcggaggattctctattatcgatattccatacgagggaaactctagtatggtaattatactaccggacgacatagaaggtatatataacatagaaaaaaatataacagatgaaaaatttaaaaaatggtgtggtatgttatctactaaaagtatagacttgtatatgccaaagtttaaagtggaaatgacagaaccgtataatctggtaccgattttagaaaatttaggacttactaatatattcggatattatgcagattttagcaagatgtgtaatgaaactatcactgtagaaaaatttctacatacgacgtttatagatgttaatgaggagtatacagaagcatcggccgttacaggagtatttacgattaacttttcgatggtatatcgtacgaaggtctacataaaccatccattcatgtacatgattaaagacaccacaggacgtatactttttatagggaaatactgctatccgcaataaatataaacaaatagacttttataaagagtcttcaacgataagtatatcgacatactacttatgctgcgaaagattctgaacgagaacgactatctcaccctcttggatcatatccgcactgctaaatactaaatctccactacactttttatcatcttatgaggaatgattgccttcgtgaaataggaataattagcaccagaatagctatggattattgtggtagagagtgcactattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttctctcgcggagtcgagagactttgtagaaacaacgaaggattaactccgctaggagtatacagtaagcatagatacgtaaaatctcagattgtgcatctactgatatccagctattcaaattcctctaacgaactcaagtcgaatataaatgatttcgatctgtattcggataatatcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacgacagtgatatgtgtaagaactctcttcattactatatatcgtctcatagagaatctcaatctctatccaaggatgtaattaaatgtttgatcgataacaatgtttccatccatggcagagacgaaggaggatctttacccatccaatactactggtctttctcaaccatagatatagagattgttaaattattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtcgttcgatgcatgttagataacggacaacaactatcctctacacgactactttgttaataataatctcgtcgatgtaaacgtcgtaaggtttatcgtggaaaatatggacacgcggctgtaaatcacgtatcgaacaatggccgtctatgtatgtacggtctgatattatcgagatttaataattgcgggtatcactgttatgaaaccatactgatagatgtatttgatatactaagcaagtacatggatgatatagatatgatcgataactctactatattacgcggtcgatgtcaataatatacaatttgcaaagcggttattggaatatggagcgagtatcacgctcgataatcaatacggccatccagaaaagcagttacagaagagaaaacaaaacgaaatcgttgttctacaagatgtctctccctacgacgattactacgtaaaaaagatactagcctactgcctattaagggacgagtcattcgcggaactacatagtaaattctgtttaaacgaggactataaaagtgtatttatgaaaaatatatcattcgataagatagattccatcatcgtgacataagtcgcctcaaagagattcgaatctccgacaccgacctgtatacggtatcacagctatcttaaagccatacattcagacagtcacatttcatttcccatgtacgacgatctcatagaacagtgccatctatcgatggagcgtaaaagtaaactcgtcgacaaagcactcaataaattagagtctaccatcggtcaatctagactatcgtatttgcctccggaaattatgcgcaatatcatctaaacagtatgttgtacggaaagaaccattacaaatattatccatgatagaaagaaaatatctatatgattggagaagtaggaaacaggaacaagacaacgattactacattattaaatcatgaagtccgtattatactcgtatatattgtttctctcatgtataataataaacggaagagatatagcaccgcatgcaccatccgatggaaagtgtaaagacaacgaatacaaacgccataatttgtgtccgggaacatacgcttccagattatgcgatagcaagactaacacacgatgtacgccgtgtggttcgggtaccttcacatctcgcaataatcatttacccgcttgtctaagttgtaacggaagacgcgatcgtgtaacacgactcacaatagaatctgtgaatgctctcccggatattattgtcttctcaaaggatcatccggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacgtttaactatatcgatgtggaaattaacctgtatccagttaacgacacgtcgtgtactcggacgaccactaccggtctcagcgaatccatctcaacgtcggaactaactattactatgaatcataaagactgtaatcccgtatttcgtgatggatacttctccgttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagtgggcgacatctatatactatatagtaataccaatactcaagactacgaaactgatacaatctcttatcatgtgggtaatgttctcgatgtcgatagccatatgcccggtagttgcgatatacataaactgatcactaattccaaacccacccactttttatagtaagtttttcacccataaataataaatacaataattaatttctcgtaaaagtagaaaatatattctaatttattgcacggtaaggaagtagaatcataaagaacagtactcaatcaatagcaattatgaaacaatatatcgtcctggcatgcatgtgcctggcggcagctgctatgcctgccagtcttcagcaatcatcctcatcctcctcctcgtgtacggaagaagaaaacaaacatcatatgggaatcgatgttattatcaaagtcacaaagcaagaccaaacaccgaccaatgataagatttgccaatccgtaacggaaattacagagtccgagtcagatccagatcccgaggtggaatcagaagatgattccacatcagtcgaggatgtagatcctcctaccacttattactccatcatcggtggaggtctgagaatgaactttggattcaccaaatgtcctcagattaaatccatctcagaatccgctgatggaaacacagtgaatgctagattgtccagcgtgtccccaggacaaggtaaggactctcccgcgatcactcatgaagaagctcttgctatgatcaaagactgtgaagtgtctatcgacatcagatgtagcgaagaagagaaagacagcgacatcaagacccatccagtactcgggtctaacatctctcataagaaagtgagttacgaagatatcatcggttcaacgatcgtcgatacaaaatgcgtcaagaatctagagtttagcgttcgtatcggagacatgtgcaaggaatcatctgaacttgaggtcaaggatggattcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaatgttcttaactacattcacaaaaagttacctctcgcgacttcttctttttctgtctcaatagtgtgatacgattatgacactattcctattcctattcctatttcctttcagagtatcacaaaaatattaaacctctttctgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaagttttacaaaaatatttttattctctttctctctttgatggtctcataaaaaagttttacaaaaatatttttattctctttctctctttgatggtctcataaaaaaagttttacaaaaatatttttattctctttctctctttgatggtctcataa

SEQ ID NO: 3 - DNA, 6022 bp, Artificial Sequence
  FSE-hNET vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttggtaccgagctctccagacattgttgaattagatcgataaaaattaattaattacccatctcagatggccagccagtgttgcaactggaactgtctgatgtccctctgagccaccaggtggtgctcgttctctggcgtgatgccataggccagtctctcccaaagagagccctgcgtgctgaggaacttatagatgacgtagatgggcaccaggaccatggaggacagggcgatgccccaccccacccagttggcccagggcgggaagatgtagtcgtcgtaggtgagtggcttgaagttgatgatgctgaccacaaccacgaacaggaggaaggcaggactgacgaacttccagcacagtctccagtatagacccggcctgaaccccatcatctgctggatgtcgttgctgaacctgtccactccataaaaccaggaaactccgatggcttccatgaggacagcaaaaaggatggaggtgcccgcagcaaaggtgtccaggagggtcaagacgtaaattccacccttggttatgcagaacagggcgagaaggaaagtgctgaaggtgacgccaaatgtgaagagtttccggtgtcgcttcaggacctggaagtcatctgccaggcccgtgatgacagcctccatgcctcccattgagctgtcaaggcccagcgccaggagcatgacgaaaaacacaacagcccagaatgtagatccagacagggtagaaatggcctctggatacaggatgaacactaggccagctccttctgtggccacatcctcaatgttgaccttgtgttcatgggccatgtaaccaaggatggagaagatggcgaacccagagacgaagctggtgatacagttgatgctgctggtcagcagggcatccctgtaacagttgttgtcaaatttgttgtaactggcaaatgcaatcaatactccaaatccagcccccaaggaaaaaaatatctgagttgcggcatcaatccataccgtggcctctttcaagcggtagaagtcgatgtgcaggtaggcattgatgccattggaggctccgggcagcgtgacgccatggaccaggagcacgaacagcacgaagtaaggcagcgtggctgtgatccacaccacctttcctgatgtcttcacccctttccagaggctaaaatacaagacgatgacgacgaccatcagacagagcaagagctgccactggggcaggccgatgtcatgaatcccgctgctctcgtgaaggtgcaggacaccacgctcataaaactcggctgccggcgtgaacttgtacttggagtacttggtgtggttgccaagcacggagccattgaggagcttggggtcggtacagttggggctgttccaggtgtggccacagtcggtccagggcaggttgagggtgaaggaggagaagaggtagtagagtgaccaggcgatgatgacgttgtagtagaagccaacgtacagggcgatcaggatgacagcatagccaacgcctttgaagaatgggcagattttccaaacggtggcagccccctcccggttgtactgtcccagagccagctccatgtagaacaggggcatccccgcgatgataaggaacagtgtgtacgggatcaagaaggcaccgccgccgttcttgtagcagaggtaggggaagcgccacacgttggccaggtccactgcgaagccgactacggacagcaggaagtcgatcttcttgccccaggtctcccggggctgcgcgtcgccgtcgcggggcgccagcaggcactggacgccgttgcgctccttcaccaccagcagctccgcagttttgcgcgcccgaaggggctgctctggacccgtgtccgccccgttgttctcgggctgcacctgcgggttcatccgcgccagaagcatggtggcgtcgacttcgagcaaaaaaagacgctagtttttcaatttttgagctcggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 4 - DNA, 32 bp, Artificial Sequence
  hNET5 primer
gtcgacgccaccatgcttctggcgcggatgaa

SEQ ID NO: 5 - DNA, 26 bp, Artificial Sequence
  hNET3 primer
gatatctcagatggccagccagtgtt

SEQ ID NO: 6 - DNA, 3519 bp, Artificial Sequence
  pCR-Blunt II-TOPO vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 7 - DNA, 4061 bp, Artificial Sequence
  pCR-SE1 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttggtaccgagctctccagacattgttgaattagatcgataaaaattaattaattacccgggtaccaggcctagatctgtcgacttcgagcaaaaaaagacgctagtttttcaatttttgagctcggatccttctgtgagcgtatggcagatggtgccaccgtagtgtactagtaacggccgccagtgtgctggaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 8 - DNA, 4059 bp, Artificial Sequence
  pNCVVf14.5lT vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgtagaagaattgataaatatgaaaccttttaagaatatgaataaaataacaattaatcaaaaggataattgtatattagcaaatcgatgctttgttaaaatagatactcctagatacataccatcgacatccattagcagttctaatatcatcagaatacggaatcatgattttacattatctgaattattgtattcaccgtttcattttcaacagcctcagtttcaatatctccttcctgggtttgtattaacgtgtattgataaagtttcgaaacagcaaaaagaatgtaaatattgtatctctaatcgtggagatgatgatagtttaagcattaatctatttattccgactattaacaagtctatatatattattatcggtttacggatgaaaaatttttggaagcctaaattcgaaatagaataatgtttttatattatacatgtgctaaaagaatgatcgatacagtttaagtgaaagctagagaggggtttttaaatggtcatcggtttagtcatattcgtgtctgtaagcttcgcaggatcctgcggccgccatcgtcggtgtgttgtctaacgtattggacatgtttatgtacgtagaagaaaataatgaagaggatgctagaatcaaggaggagcaagaactactgttgctatattaatacataattgaaaatctaccaacttaaatacaccgcctataaatttacaatgaaacacagattgtattctgaaggattgagtattagtaatgatttaaactcgataatcggtcaacaatctacaatggatacggatatagaaatagacgaagatgacatcatggaacttcttaatatattgactgagttaggttgtgatgtcgactttgatgaaaattttagcgatatagccgatgatattctagaatcgttgatagaacaggatgtataagtttttatgttaactaaatgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 9 - DNA, 7398 bp, Artificial Sequence
  TK-SE-hNET3 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgaagtcgacatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 10 - DNA, 5834 bp, Artificial Sequence
  TK-SE-mIP10-1 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcaaaaattgaaaaactagcgtctttttttgctcgaagtcgacgccaccatgaacccaagtgctgccgtcattttctgcctcatcctgctgggtctgagtgggactcaagggatccctctcgcaaggacggtccgctgcaactgcatccatatcgatgacgggccagtgagaatgagggccatagggaagcttgaaatcatccctgcgagcctatcctgcccacgtgttgagatcattgccacgatgaaaaagaatgatgagcagagatgtctgaatccggaatctaagaccatcaagaatttaatgaaagcgtttagccaaaaaaggtctaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 11 - DNA, 7396 bp, Artificial Sequence
  TK-SL-hNET3
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 12 - DNA, 5832 bp, Artificial Sequence
  TK-SL-mIP10-1 vector
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttgttacagatggaagggtcaaacttaataaaggatatttgttcgactttgtgattagtttgatgcgattcaaaaaagaatcctctctagctaccaccgcaatagatcctgttagatacatagatcctcgtcgtgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgtttaattctgtgagcgtatggcaaacggtaccgagctcttttttttttttttttttttggcatataaataagtcgacgccaccatgaacccaagtgctgccgtcattttctgcctcatcctgctgggtctgagtgggactcaagggatccctctcgcaaggacggtccgctgcaactgcatccatatcgatgacgggccagtgagaatgagggccatagggaagcttgaaatcatccctgcgagcctatcctgcccacgtgttgagatcattgccacgatgaaaaagaatgatgagcagagatgtctgaatccggaatctaagaccatcaagaatttaatgaaagcgtttagccaaaaaaggtctaattaattaatttttatcgatctaattcaacaatgtctggagagctcggatccttctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtactagttaacggccgccagtgtgctggaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcaagccgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaattcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatcccaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgttgtttaattctgtgagcgtatggcaaacg

SEQ ID NO: 13 - DNA, 5767 bp, Artificial Sequence
  HA-SE-hNET vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcaaaaattgaaaaactagcgtctttttttgctcgaagtcgacgccaccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagatgggtaattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 14 - DNA, 4479 bp, Artificial Sequence
  HA-SE-RLN-7 vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcaaaaattgaaaaactagcgtctttttttgctcgaagtcgaccaccatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgaaggcctggtacccgggtaattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 15 - DNA, 4557 bp, Artificial Sequence
  HA-SE-IL24-1 vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcaaaaattgaaaaactagcgtctttttttgctcgaagtcgaccaccatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgataacccgggaagggcgaattctgcagatgggtaattaattaatttttatcgatctaattcaacaatgtctggagagcttcgcaggatcccgactccggaaccaattactgataaagaagatcatacagtcacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 16 - DNA, 32 bp, Artificial Sequence
  mda-5 primer
gtcgaccaccatgaattttcaacagaggctgc

SEQ ID NO: 17 - DNA, 34 bp, Artificial Sequence
  mda-3 primer
cccgggttatcagagcttgtagaatttctgcatc

SEQ ID NO: 18 - DNA, 5834 bp, Artificial Sequence
  HA-SE-hNIS-1 vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcaaaaattgaaaaactagcgtctttttttgctcgaagtcgaccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 19 - DNA, 30 bp, Artificial Sequence
  hNIS-5 primer
gtcgaccaccatggaggccgtggagaccgg

SEQ ID NO: 20 - DNA, 36 bp, Artificial Sequence
  hNIS-3 primer
ttaattaatcagaggtttgtctcctgctggtctcga

SEQ ID NO: 21 - DNA, 5859 bp, Artificial Sequence
  HA-SEL-hNIS-2 vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagcttaaaaattgaaattttattttttttttttggaatataaataagctcgaagtcgaccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgattaattaatttttatcgatctaattcaacaatgtctggagagctcggtaccaagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 22 - DNA, 4514 bp, Artificial Sequence
  HA-SEL-RLN-2 vector
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcggtttggaattagtgaaagcttaaaaattgaaattttattttttttttttggaatataaataagctcgaagtcgaccaccatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgaaggcctggtacccgggtaattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 23 - DNA, 5832 bp, Artificial Sequence
  HA-SL-hNIS-1
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcttttttttttttttttttttggcatataaataagtcgaccaccatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 24 - DNA, 4477 bp, Artificial Sequence
  HA-SL-RLN-3
gacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatctaagctcttttttttttttttttttttggcatataaataagtcgaccaccatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgaaggcctggtacccgggtaattaattaatttttatcgatctaattcaacaatgtctggagagcttcgcaggatcccgactccggaaccaattactgataaagaagaagatcatacagttacagacactgtctcatacactacagtaagtacatcatctggaattgtcactactaaatcaaccaccgatgatacgtacaatgataatgatacagtaccaccaactactgtaggcggtagtacaacctctattagcaattataaaaccaaggactttgtagaaatatttggtattaccgcattaattatattgtcggccgtggcaatattctgtattacgtattatatatgtaataaacgttcacgtaaatacaaaacagagaacaaagtctagatttttgacttacataaatgtctgggatagtaaaatctatcagaattctagaaaagtagaaaatatattctaatttattgcacgggatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaggatcagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacct

SEQ ID NO: 25 - DNA, 1854 bp, Homo sapiens
  norepinephrine transporter cDNA
atgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctga

SEQ ID NO: 26 - protein, 617 aa, Homo sapiens [sequence omitted]

SEQ ID NO: 27 - protein, 615 aa, Bos taurus
  Norepinephrine transporter (P51143)
MLLARMNPQVQPENGGAGPGSEQPPRKRKEVLVVKERNGVQCLLASRDGDEQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTPTLPWTDCGHAWNSPNCTDPKLLNSSVLGNHTKYSKYKFTPAAEFYERGVLHLHESSGIHDIGLPQWQLLLCLIIVVIVLFFSLWKGVKTSGKVVWITATLPYLVLFVLLVHGITLPGASNGINAYLHIDFYRLKEATVWIDAATQIFFSLGAGFGVLIAFASYNKFDNNCYRDALLTSTINCVTSFISGFAIFSILGYMAHEHKVNIEDVATEGAGLVFILYPEAISTLSGSTFWAIVFFIMLLALGIDSSMGGMEAVITGLADDFQVLKRHRKLFTFAVSFGTFLLALFCITKGGIYVLTLLDTFAAGTSILFAVLMEAIGVSWFYGVDRFSNDIQQMMGFKPGLYWRLCWKFVSPAFLLFVVIVSIINFKPLTYDDYIFPLWANWVGWGIAGSSMVLVPAYIVYKFFSTRGSIRERLAYGITPASEHHLVAQRDIRQFQLQHWLAI

SEQ ID NO: 28 - protein, 617 aa, Mus musculus
  Norepinephrine transporter (O55192)
MLLARMNPQVQPELGGADPLPEQPLRPCKTADLLVVKERNGVQCLLASQDSDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFASFTLNLPWTNCGHSWNSPNCTDPKLLNASVLGDHTKYSKYKFTPAAEFYERGVLHLHESSGIHDIGLPQWQLLLCLMVVIVVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSTINCVTSFISGFAIFSILGYMAHEHKVNIEDVATEGAGLVFILYPEAISTLSGSTFWAVLFFLMLLALGLDSSMGGMEAVITGLADDFQVLKRHRKLFTCVVTISTFLLALFCITKGGIYVLTLLDTFAAGTSILFAVLMEAIGVSWFYGVDRFSNDIQQMMGFKPGLYWRLCWKFVSPAFLLFVVVVSIINFKPLTYDDYTYPPWANWVGWGIALSSMILVPAYVIYKFLSIRGSLWERVAYGITPENEHHLVAQRDVRQLPLQHWLAI

SEQ ID NO: 29 - protein, 617 aa, Rattus norvegicus
  Norepinephrine transporter (Q63380)
MLLARMKPQVQPELGGADQLPEQPLRPCKTADLLVVKERNGVQCLLASQDGDAQPRETWGKEIDFLLSVVGFAVDLANVWRFPYLCYKNGGGAFLIPYTLFLIIAGMPLFYMELALGQFNREGAATVWKICPFFKGVGYAVILIALYVGFYYNVIIAWSLYYLFASFTLNLPWTNCGHAWNSPNCTDPKLLNASVLGDHTKYSKYKFTPAAEFYERGVLHLHESSGIHDIGLPQWQLLLCLMVVIVVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSTINCVTSFISGFAIFSILGYMAHEHKVKIEDVATEGAGLVFVLYPEAISTLSGSTFWAVLFFLMLLALGLDSSMGGMEAVITGLADDFQVLKRHRKLFTCAVTLGTFLLAMFCITKGGIYVLTLLDTFAAGTSILFAVLMEAIGVSWFYGVDRFSNDIQQMMGFKPGLYWRLCWKFVSPAFLLFVVVVSIINFKPLTYDDYVYPPWANWVGWGIALSSMILVPAYVIYKFFSIRGSLWERVAYGITPENEHHLVAQRDVRQFQLRHWLAI

SEQ ID NO: 30 - protein, 617 aa, Macaca mulatta
  Norepinephrine transporter (Q9MYW8)
MLLARMNPQVQPENSGADAGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVVVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFIMLLALGLDSSMGGMEAIITGLADDFQVLKRHRKLFTFGVTFGTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDVRQFQLQHWLAI

SEQ ID NO: 31 - protein, 635 aa, Gallus gallus
  Norepinephrine transporter (Q9DGN5)
MGQRHPQCYLARMNKQIQPDRKVSVVAPLPERPGPSPPRKDVELILVKEHNGVQYTSSNLLPAAPAPRYGPQDRETWGKKIDFLLSVIGFAVDLANVWRFPYLCYKNGGGAFLIPYILFLIIAGMPLFYMELALGQYNREGAATVWKICPVFKGVGYAVILIALYVGFYYNVIIAWSLYYLFSSFTFELPWTNCDNSWNSPNCTDPKLFNASVLGNGTKYSKYKLTPAAEFYERGVLHLHESRGIHDLGLPRWQLSLCLLVVVIILFFSLWKGVKTSGKVVWITATLPYVVLFVLLIHGITLPGAYNGINAYLHIDFRRLKEATVWIDAATQIFYSLGAGFGVLIAFASYNKFDNNCYRDALLTSTINCVTSFISGFAIFSILGYMAHEHKVKIEDVATEGAGLVFILYPEAISTLSGSTFWAVVFFIMLLTLGIDSSMGGMEAVITGLADDFHILKQHRKLFTFGVSFGTFLLALFCITNGGIYVLTLLDTFAAGTSILFAVLMEAIGVSWFYGVDRFSEDIQQMMGFKPGLYWRLCWKFVSPAFLLFVVIVSIINFKPLTYDDYTFPFWANRIGWGIALSSMILVPAYVIYKFMNVRGTFKERLAYCITPENEHQLVAQGNVRQFKLQHWLTI

SEQ ID NO: 32 - protein, 106 aa, Ovis aries
  norepinephrine transporter fragment (Q9GMA4)
  VARIANT (4)...(4): Xaa= unknown
  VARIANT (10)...(10): Xaa= unknown
  VARIANT (41)...(41): Xaa= unknown
  VARIANT (53)...(57): Xaa= unknown
  VARIANT (64)...(64): Xaa= unknown
  VARIANT (90)...(90): Xaa= unknown
  VARIANT (99)...(100): Xaa= unknown
RLLXPYTLFXIIAGMPLFYMELALGQYNREGLPPFGNLPIXQRRWLCCHPDRXXXXXYNNVIIXWSLYYLFSSFTLNLPWTDCGHTWNSXNCTDTKLLXXSVLNHT

SEQ ID NO: 33 - protein, 515 aa, Coturnix coturnix japonica
  Norepinephrine transporter fragment (Q9I8Q2)
ENWGKKIDFLLSVIGFAVDLANVWRFPYLCYKNGGGAFLIPYILFLIIAGMPLFYMELALGQYNREGAATVWKICPVFKGVGYAVILIALYVGFYYNVIIAWSLYYLFSSFTFELPWTNCDNSWNNPNCTNPKLFNASVLGNGTKYSKYKLTPAAEFYERGVLHLHESRGIHDLGLPRWQLSLCLLVVVIILFFSLWKGVKTSGKVVWITATLPYVVLFVLLIHGITLPGAYNGINAYLHIDFRRLKEATVWIDAATQIFYSLGAGFGVLIAFASYNRFDNNCYRDALLTSTINCVTSFISGFAIFSILGYMAHEHKVKIEDVATEGAGLVFILYPEAISTLSGSTFWAVVFFIMLLTLGIDSSMGGMEAVITGLADDFHILKQHRKLFTFGVSFGTFLLALFCITNGGIYVLTLLDTFAAGTSILFAVLMEAIGISWFYGVDRFSEDIQQMMGFKPGLYWRLCWKFVSPAFLLFVVIVSIINFKPLTYDDYTFPLWANRIGWGIALSSMLLVPA

SEQ ID NO: 34 - protein, 630 aa, Homo sapiens
  Sodium-dependent serotonin transporter (P31645)
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 35 - protein, 620 aa, Homo sapiens
  sodium-dependent dopamine transporter (Q01959)
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 36 - protein, 599 aa, Homo sapiens
  Sodium- and chloride-dependent GABA transporter 1 (P30531)
MATNGSKVADGQISTEVSEAPVANDKPKTLVVKVQKKAADLPDRDTWKGRFDFLMSCVGYAIGLGNVWRFPYLCGKNGGGAFLIPYFLTLIFAGVPLFLLECSLGQYTSIGGLGVWKLAPMFKGVGLAAAVLSFWLNIYYIVIISWAIYYLYNSFTTTLPWKQCDNPWNTDRCFSNYSMVNTTNMTSAVVEFWERNMHQMTDGLDKPGQIRWPLAITLAIAWILVYFCIWKGVGWTGKVVYFSATYPYIMLIILFFRGVTLPGAKEGILFYITPNFRKLSDSEVWLDAATQIFFSYGLGLGSLIALGSYNSFHNNVYRDSIIVCCINSCTSMFAGFVIFSIVGFMAHVTKRSIADVAASGPGLAFLAYPEAVTQLPISPLWAILFFSMLLMLGIDSQFCTVEGFITALVDEYPRLLRNRRELFIAAVCIISYLIGLSNITQGGIYVFKLFDYYSASGMSLLFLVFFECVSISWFYGVNRFYDNIQEMVGSRPCIWWKLCWSFFTPIIVAGVFIFSAVQMTPLTMGNYVFPKWGQGVGWLMALSSMVLIPGYMAYMFLALKGSLKQRIQVMVQPSEDTVRPENGPEHAQAGSSTSKEAYI

SEQ ID NO: 37 - protein, 569 aa, Homo sapiens
  Sodium- and chloride-dependent GABA transporter 2 (Q9NSD5)
MDSRVSGTTSNGETKPVYHKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFPVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSWSAFLPGASTDSEPSRAPSERESVSSCAQPRTCPSGTQQDPRLPPPPGPHCSDSQS

SEQ ID NO: 38 - protein, 632 aa, Homo sapiens
  Sodium- and chloride-dependent GABA transporter 3 (P48066)
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWEHRVLAISDGIEHIGNLRWELALCLLAAWTICYFCIWKGTKSTGKVVYVTATFPYIMLLILLIRGVTLPGASEGIKFYLYPDLSRLSDPQVWVDAGTQIFFSYAICLGCLTALGSYNNYNNNCYRDCIMLCCLNSGTSFVAGFAIFSVLGFMAYEQGVPIAEVAESGPGLAFIAYPKAVTMMPLSPLWATLFFMMLIFLGLDSQFVCVESLVTAVVDMYPKVFRRGYRRELLILALSVISYFLGLVMLTEGGMYIFQLFDSYAASGMCLLFVAIFECICIGWVYGSNRFYDNIEDMIGYRPPSLIKWCWMIMTPGICAGIFIFFLIKYKPLKYNNIYTYPAWGYGIGWLMALSSMLCIPLWICITVWKTEGTLPEKLQKLTTPSTDLKMRGKLGVSPRMVTVNDCDAKLKSDGTIAAITEKETHF

SEQ ID NO: 39 - protein, 797 aa, Homo sapiens
  Sodium- and chloride-dependent glycine transporter 2 (Q9Y345)
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPSLRGPEGDANVSVGKGTLERNNTPVVGWVNMSQSTVVLGTDGITSVLPGSVATVATQEDEQGDENKARGNWSSKLDFILSMVGYAVGLGNVWRFPYLAFQNGGGAFLIPYLMMLALAGLPIFFLEVSLGQFASQGPVSVWKAIPALQGCGIAMLIISVLIAIYYNVIICYTLFYLFASFVSVLPWGSCNNPWNTPECKDKTKLLLDSCVISDHPKIQIKNSTFCMTAYPNVTMVNFTSQANKTFVSGSEEYFKYFVLKISAGIEYPGEIRWPLALCLFLAWVIVYASLAKGIKTSGKVVYFTATFPYVVLVILLIRGVTLPGAGAGIWYFITPKWEKLTDATVWKDAATQIFFSLSAAWGGLITLSSYNKFHNNCYRDTLIVTCTNSATSIFAGFVIFSVIGFMANERKVNIENVADQGPGIAFVVYPEALTRLPLSPFWAIIFFLMLLTLGLDTMFATIETIVTSISDEFPKYLRTHKPVFTLGCCICFFIMGFPMITQGGIYMFQLVDTYAASYALVIIAIFELVGISYVYGLQRFCEDIEMMIGFQPNIFWKVCWAFVTPTILTFILCFSFYQWEPMTYGSYRYPNWSMVLGWLMLACSVIWIPIMFVIKMHLAPGRFIERLKLVCSPQPDWGPFLAQHRGERYKNMIDPLGTSSLGLKLPVKDLELGTQC

SEQ ID NO: 40 - protein, 692 aa, Homo sapiens
  Sodium- and chloride-dependent glycine transporter 1 (P48067)
MAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 41 - protein, 636 aa, Homo sapiens
  Sodium-dependent proline transporter (Q99884)
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALLVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 42 - protein, 620 aa, Homo sapiens
  Sodium- and chloride-dependent taurine transporter (P31641)
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 43 - protein, 614 aa, Homo sapiens
  Sodium- and chloride-dependent betaine transporter (P48065)
MDGKVAVQEYGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 44 - protein, 635 aa, Homo sapiens
  Sodium- and chloride-dependent creatine transporter 1 (P48029)
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 45 - protein, 617 aa, Artificial Sequence
  N7K Mutant NET
MLLARMKPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 46 - protein, 617 aa, Artificial Sequence
  V69I Mutant NET
MLLARMNPQVQPENNGADTGPEQPLRARKTAELLVVKERNGVQCLLAPRDGDAQPRETWGKKIDFLLSIVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 47 - protein, 617 aa, Artificial Sequence
  T99I Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYILFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 48 - protein, 617 aa, Artificial Sequence
  V245I Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVIIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 49 - protein, 617 aa, Artificial Sequence
  T283R Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVRLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 50 - protein, 617 aa, Artificial Sequence
  N292T Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGITAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 51 - protein, 617 aa, Artificial Sequence
  V356L Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFLSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 52 - protein, 617 aa, Artificial Sequence
  A369P Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMPHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 53 - protein, 617 aa, Artificial Sequence
  N375S Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVSIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 54 - protein, 617 aa, Artificial Sequence
  V449I Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGITFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 55 - protein, 617 aa, Artificial Sequence
  A457P Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLPLFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 56 - protein, 617 aa, Artificial Sequence
  K463R Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITRGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 57 - protein, 617 aa, Artificial Sequence
  G478S Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAASTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 58 - protein, 617 aa, Artificial Sequence
  F528C Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPACLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 59 - protein, 617 aa, Artificial Sequence
  Y548H Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDHIFPPWANWVGWGIALSSMVLVPIYVIYKFLSTQGSLWERLAYGITPENEHHLVAQRDIRQFQLQHWLAI

SEQ ID NO: 60 - protein, 617 aa, Artificial Sequence
  I549T Mutant NET
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYTFPPWANWVGWGIALSSMVLVPIYVIYKFLSTQGSLWERLAYGITPENEHHLVAQRDIRQFQLQHWLAI

SEQ ID NO: 61 - protein, 613 aa, Homo sapiens
  NET isoform 1 (3 aa from exon 15)
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLSF

SEQ ID NO: 62 - protein, 628 aa, Homo sapiens
  NET isoform 2 (18 aa from exon 15)
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQMKTRQGRRRATNSCQISC

SEQ ID NO: 63 - protein, 643 aa, Homo sapiens
  NIS (Q92911)
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 64 - DNA, 1929 bp, Homo sapiens
  NIS ORF
atggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctc

SEQ ID NO: 65 - protein, 618 aa, Mus musculus
  NIS (Q99PN0)
MEGAEAGARATFGPWDYGVFATMLLVSTGIGLWVGLARGGQRSADDFFTGGRQLAAVPVGLSLAASFMSAVQVLGVPAEAARYGLKFLWMCVGQLLNSLLTALLFLPIFYRLGLTSTYQYLELRFSRAVRLCGTLQYLVATMLYTGIVIYAPALILNQVTGLDIWASLLSTGIICTLYTTVGGMKAVVWTDVFQVVVMLVGFWVILARGVMLMGGPWNVLSLAQNHSRINLMDFDPDPRSRYTFWTFVVGGSLVWLSMYGVNQAQVQRYVACHTERKAKLALLVNQLGLFLIVASAACCGIVMFVYYKDCDPLLTGRIAAPDQYMPLLVLDIFEDLPGVPGLFLACAYSGTLSTASTSINAMAAVTVEDLIKPRMPSLAPRKLVFISKGLSFIYGSTCLTVAALSSLLGGGVLQGSFTVMGVISGPLLGAFTLGMLLPACNTPGVLSGLTAGLAVSLWVAVGATLYPPGEQTMGVLPTSAAGCTNASVLPSPPGAANTSRGIPSSGMDSGRPAFADTFYAVSYLYYGALGTLTTMLCGALISYLTGPTKRSSLGPGLLWWDLARQTASVAPKEDTTTLEDSLVKGPEDIPAATKKPPGFRPEAETHPLYLGHDVETNL

SEQ ID NO: 66 - protein, 618 aa, Rattus norvegicus
  NIS (Q63008)
MEGAEAGARATFGAWDYGVFATMLLVSTGIGLWVGLARGGQRSADDFFTGGRQLAAVPVGLSLAASFMSAVQVLGVPAEAARYGLKFLWMCAGQLLNSLLTAFLFLPIFYRLGLTSTYQYLELRFSRAVRLCGTLQYLVATMLYTGIVIYAPALILNQVTGLDIWASLLSTGIICTLYTTVGGMKAVVWTDVFQVVVMLVGFWVILARGVILLGGPRNVLSLAQNHSRINLMDFDPDPRSRYTFWTFIVGGTLVWLSMYGVNQAQVQRYVACHTEGKAKLALLVNQLGLFLIVASAACCGIVMFVYYKDCDPLLTGRISAPDQYMPLLVLDIFEDLPGVPGLFLACAYSGTLSTASTSINAMAAVTVEDLIKPRMPGLAPRKLVFISKGLSFIYGSACLTVAALSSLLGGGVLQGSFTVMGVISGPLLGAFTLGMLLPACNTPGVLSGLAAGLAVSLWVAVGATLYPPGEQTMGVLPTSAAGCTNDSVLLGPPGATNASNGIPSSGMDTGRPALADTFYAISYLYYGALGTLTTMLCGALISYLTGPTKRSSLGPGLLWWDLARQTASVAPKEDTATLEESLVKGPEDIPAVTKKPPGLKPGAETHPLYLGHDVETNL

SEQ ID NO: 67 - protein, 601 aa, Danio rerio
  NIS (A4IG60)
MAMDSDRPPGFCLVDYAVFAAMLGVSVGIGLFQSLRKTPGRSKVDSFFTGGRGFSAVPVGLSLCASFMSAVQVLGVPSETYLYGFKFLYMCLGQGLNSLMTAVLFVPVFYRLKITSSSQYLGMRFGRGMQLLGSLQFIVATLLYTGIVIFAPAVILNQATGLNMWASLFSTGLICTFYTTVGGMKAVIWTDVFQIVVMLSGFIAVFIQGTILAGGPARVLEIANNGSRINFNDFAIDPQRRYSFWSFTVGGTMVWLSMYGANQAQVQRYISCRTEKQAQLALLVNQVGLCLIVSSAATCGIVMFALYSNCDPLKIGRISAPDQYMPYLVLDIFRNHPGFPGLFLACAYSGTLSTVSTSINAMAAVTMEDVMKPWLITISQRKQLMLSRALSLFYGLGCITMAALSSLLDWGVLQGSFTVMGVVNGPLLGAFALGMFVPATNKPGVFSGVAVGFCLSLWLAVGSTIYPPSPQIMGVLPTSAGQCLTTNATLNTTASVLASSVPLDYSFQNIYSISYLYFGALSTSAVVLVGVVVSYITGPTKKDSISPGLLRWNLEQKPCDASCHILNETITLNPTEILLTPKELFPIAADKQDILLTKGEI

SEQ ID NO: 68 - protein, 684 aa, Xenopus laevis
  NIS (Q6DDF5)
MDTQCWKHLLPPFLLNLWAPAQHLQHTFVSSHRSPGTELMEEYVPLVHESLTFSLWDYGVFAVMLLMSTGIGLFYAFSHGGQKTSDDFFTGGRSMSAVPVGLSLSASFMSAVQVLGVPAESYRYGVKFLQMCIGQILNSLMTAYIFMPIFYRLGITSTYEYLEMRFSRSVRLYGTIQFLLGTMFYTGIVIYAPALILNQVTGLDIWASLFSTGAICTFYTTVGGMKAVIWTDVFQVLVMLSGFFAVAIRGIHLVGGFSDAIEIAGNYSRINFGDFDPDPRRRYTFWTFVMGSTFLWLSMYGVNQAQVQRYVACKTENEAKLAILVNQVALCVIVSSAVTCGIVMFVYYLNCDPLLAGYVSAPDQYMPYFVLEIFDQYPGIPGLFLACAYSGTLSTASTSINAMAAVTVEDLIKPKYPNIPTKKLTFISKGLSLIYGCSCITVAALSSLLGGGVLQGSFTVMGVISGPLLGAFMLGMFFVSCNTIGVFAGLLVGLVLSLWVAVGGTIYPPSAEMMGVLPTYAEHCPLFNSSKGIIYGPAPVQNITHTMERPALAEDLYALSYLYYGVVGTFSTIIIGVIVSKFTGPTKRETIAPGLLWWDLSNSAAFQPMEKKDDLEKTEVEETLLKKDNTFHCTTFLPNHLPHSETSTYLLSEEYSPGNDSYSNGEKTYPLKTINGYEDKESRV

SEQ ID NO: 69 - protein, 664 aa, Homo sapiens
  sodium/glucose cotransporter 1 (P13866)
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 70 - protein, 672 aa, Homo sapiens
  sodium/glucose cotransporter 2 (P31639)
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 71 - protein, 718 aa, Homo sapiens
  sodium/myo-inositol cotransporter (P53794)
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 72 - protein, 659 aa, Homo sapiens
  low affinity sodium-glucose cotransporter (Q9NY91)
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 73 - protein, 635 aa, Homo sapiens
  sodium-dependent multivitamin transporter (Q9Y289)
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGFSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 74 - protein, 580 aa, Homo sapiens
  High affinity choline transporter 1 (Q9GZV3)
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 75 - protein, 610 aa, Homo sapiens
  sodium-coupled monocarboxylate transporter 1 (Q8N695)
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQVGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLITTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 76 - protein, 681 aa, Homo sapiens
  Sodium/glucose cotransporter 4 (Q2M3M2)
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 77 - protein, 596 aa, Homo sapiens
  sodium/glucose cotransporter 5 (A0PJK1)
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 78 - protein, 569 aa, Homo sapiens
  Isoform 2 of sodium/glucose cotransporter 5
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 79 - protein, 565 aa, Homo sapiens
  Isoform 3 of sodium/glucose cotransporter 5
MTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRTGIPSTPPAPQSRLSFLLPETPPLERYLLGLVVMDLWVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 80 - protein, 612 aa, Homo sapiens
  Isoform 4 of sodium/glucose cotransporter 5
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 81 - protein, 675 aa, Homo sapiens
  sodium/myo-inositol cotransporter 2 (Q8WWX8)
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 82 - protein, 640 aa, Homo sapiens
  Isoform 2 of sodium/myo-inositol cotransporter 2
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 83 - protein, 611 aa, Homo sapiens
  Isoform 3 of sodium/myo-inositol cotransporter 2
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 84 - protein, 742 aa, Homo sapiens
  Isoform 4 of sodium/myo-inositol cotransporter 2
MESGTSSPQPPQLDPLDAFPQKGLEPGDIAVLVLYFLFVLAVGLWVGSPSVAQGTRTQWWQSWLTPASTSWAQVILSPRLPDTEEVLSTRNRLSPDTKPLGALILNFQVSRISTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 85 - protein, 618 aa, Homo sapiens
  sodium-coupled monocarboxylate transporter 2 (Q1EHB4)
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCLLFGVMCTSMAVAASVMGGVVQASLSIHGMCGGPMLGLFSLGIVFPFVNWKGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 86 - protein, 396 aa, Homo Sapiens
  Isoform 2 of sodium-coupled monocarboxylate transporter 2
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCRYSWWTFYSIS

SEQ ID NO: 87 - protein, 643 aa, Homo sapiens
  G93R mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLRQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 88 - protein, 643 aa, Homo sapiens
  A102P mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTPLLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 89 - protein, 643 aa, Homo sapiens
  Q267E mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVERYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 90 - protein, 643 aa, Homo sapiens
  T354P mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSPASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 91 - protein, 643 aa, Homo sapiens
  G395R mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYRSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 92 - protein, 643 aa, Homo sapiens
  T536Q mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGQLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 93 - protein, 643 aa, Homo sapiens
  G543E mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCEALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 94 - protein, 643 aa, Homo sapiens
  S556Q mutant NIS
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRQTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 95 - protein, 633 aa, Homo sapiens
  Isoform 2 of sodium- and chloride-dependent glycine transporter 1
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 96 - protein, 638 aa, Homo sapiens
  Isoform 3 of sodium- and chloride-dependent glycine transporter 1
MAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLACAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQSLHPDKAQIPIVGSNGSSRLQDSRI

SEQ ID NO: 97 - protein, 426 aa, Homo sapiens
  Sodium- and chloride-dependent creatine transporter 2 (P53796)
IVYFTATFPYVVVVVLLVLGVLLPGALDSIIYYLKPDWSKLGSPQVWIDVGTQIFFSYAIGLGALTALGSYNRFNNNCYKDAIILAVINSGTSFFAGFVVFSILGFMAAEQGMHISKVAESGPGLAFIAYPQAVTLMPVAPLWAALFFFMLLLLGLDNQFVGVEGFITGLLNLLPASYYFCFQREISVALCCALRFVIDLSMVTDGGMYVFQLFDYYSASGTTLLWQAFWECVVVVWVYGADRFTDDIACMIGYRPCPWMKWCWSFFTPLVCMGIFIFNVVYYKPLVYNNTYVYPWWGEAMGWAFVLSSMLCMPLHLLGCLLRAKGTMAECWKHLTQPIWGLHHLEYRAQDADVRGLTTLTPVSESSKVVVVESVMGQLSSHHQLTSGSHSSPCFIPTPPLQGACLSLTLLGSAWERRGESTMSAH

SEQ ID NO: 98 - protein, 642 aa, Homo sapiens
  Sodium- and chloride-dependent neutral and basic amino acid transporter B(0+) (Q9UN76)
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 99 - protein, 730 aa, Homo sapiens
  Orphan sodium- and chloride-dependent neurotransmitter transporter NTT73 (Q9H2J7)
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 100 - protein, 736 aa, Homo sapiens
  Orphan sodium- and chloride-dependent neurotransmitter transporter NTT5 (SLC6A16)
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 101 - protein, 727 aa, Homo sapiens
  Orphan sodium- and chloride-dependent neurotransmitter transporter NTT4 (Q9H1V8)
MPKNSKVTQREHSSEHVTESVADLLALEEPVDYKQSVLNVAGEAGGKQKAVEEELDAEDRPAWNSKLQYILAQIGFSVGLGNIWRFPYLCQKNGGGAYLVPYLVLLIIIGIPLFFLELAVGQRIRRGSIGVWHYICPRLGGIGFSSCIVCLFVGLYYNVIIGWSIFYFFKSFQYPLPWSECPVVRNGSVAVVEAECEKSSATTYFWYREALDISDSISESGGLNWKMTLCLLVAWSIVGMAVVKGIQSSGKVMYFSSLFPYVVLACFLVRGLLLRGAVDGILHMFTPKLDKMLDPQVWREAATQVFFALGLGFGGVIAFSSYNKQDNNCHFDAALVSFINFFTSVLATLVVFAVLGFKANIMNEKCVVENAEKILGYLNTNVLSRDLIPPHVNFSHLTTKDYMEMYNVIMTVKEDQFSALGLDPCLLEDELDKSVQGTGLAFIAFTEAMTHFPASPFWSVMFFLMLINLGLGSMIGTMAGITTPIIDTFKVPKEMFTVGCCVFAFLVGLLFVQRSGNYFVTMFDDYSATLPLTLIVILENIAVAWIYGTKKFMQELTEMLGFRPYRFYFYMWKFVSPLCMAVLTTASIIQLGVTPPGYSAWIKEEAAERYLYFPNWAMALLITLIVVATLPIPVVFVLRHFHLLSDGSNTLSVSYKKGRMMKDISNLEENDETRFILSKVPSEAPSPMPTHRSYLGPGSTSPLETSGNPNGRYGSGYLLASTPESEL

SEQ ID NO: 102 - protein, 628 aa, Homo sapiens
  Sodium- and chloride-dependent transporter XTRP2 (Q96N87)
MAHAPEPDPAACDLGDERPKWDNKAQYLLSCIGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNMHILQNPRVWLDAATQIFFSLSLAFGGHIAFASYNSPRNDCQKDAVVIALVNRMTSLYASIAVFSVLGFKATNDYEHCLDRNILSLINDFDFPEQSISRDDYPAVLMHLNATWPKRVAQLPLKACLLEDFLDKSASGPGLAFVVFTETDLHMPGAPVWAMLFFGMLFTLGLSTMFGTVEAVITPLLDVGVLPRWVPKEALTGLVCLVCFLSATCFTLQSGNYWLEIFDNFAASLNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 103 - protein, 634 aa, Homo sapiens
  Sodium-dependent neutral amino acid transporter B(0) (Q695T7)
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 104 - protein, 592 aa, Homo sapiens
  Sodium- and chloride-dependent transporter XTRP3 (Q9NP91)
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 105 - protein, 264 aa, Artificial Sequence
  tTF-RGD protein
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFRGRGDSPDYKDDDDK

SEQ ID NO: 106 - protein, 272 aa, Artificial Sequence
  G6-FLAG protein sequence
METDTLLLWVLLLWVPGSTGDEVQLVESGGGLVQPGGSLRLSCAASGFTISDYWIHWVRQAPGKGLEWVAGITPAGGYTYYADSVKGRFTISADTSKNTAYLQMNSLRAEDTAVYYCARFVFFLPYAMDYWGQGTLVTVSSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQGYGNPFTFGQGTKVEIKRDYKDDDDK

SEQ ID NO: 107 - protein, 207 aa, Artificial Sequence
  IL-24
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 108 - protein, 520 aa, Artificial Sequence
  sIL-6R/IL-6 fusion
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPARGGGGSGGGGSVEPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 109 - protein, 121 aa, Artificial Sequence
  human plasminogen kringle 5 domain
MYRMQLLSCIALSLALVTNSPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFD

SEQ ID NO: 110 - DNA, 624 bp, Artificial Sequence
  IL-24 cDNA
atgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctga

SEQ ID NO: 111 - DNA, 1572 bp, Artificial Sequence
  sIL-6R/IL-6 fusion cDNA
atgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctcgaggaggtggaggttctggaggtggaggttctgtcgagccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcac

SEQ ID NO: 112 - DNA, 366 bp, Homo sapiens
  DNA encoding the human plasminogen kringle 5 domain
atgtacaggatgcaactcctgtcttgcattgcactaagtcttgcacttgtcacgaattcgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattag

The invention claimed is:

1. A recombinant vaccinia virus, comprising:
a nucleic acid that encodes a sodium-dependent transporter protein; and
a nucleic acid that encodes a therapeutic agent.

2. The recombinant vaccinia virus of claim 1, wherein the sodium-dependent transporter protein is selected from among a sodium-dependent transporter protein of the solute carrier 5 family and a sodium-dependent transporter protein of the solute carrier 6 family.

3. The recombinant vaccinia virus of claim 1, wherein the sodium-dependent transporter protein is a norepinephrine transporter (NET) or is a sodium-iodide symporter (NIS).

4. The recombinant vaccinia virus of claim 3, wherein the sodium-dependent transporter protein is a norepinephrine transporter that is a human norepinephrine transporter (hNET).

5. The recombinant vaccinia virus of claim 3, wherein the sodium-dependent transporter protein is a sodium-iodide symporter that is a human sodium-iodide symporter (hNIS).

6. The recombinant vaccinia virus of claim 1, that is a Lister strain virus.

7. The recombinant vaccinia virus of claim 6, that is a LIVP strain virus.

8. The recombinant vaccinia virus of claim 1, wherein the nucleic acid encoding the transporter protein is inserted in the hemagglutinin (HA), thymidine kinase (TK) or F14.5 gene or locus.

9. The recombinant vaccinia virus of claim 1, wherein the therapeutic agent is an anti-cancer agent or an anti-angiogenic agent or an agent that has both activities.

10. The recombinant vaccinia virus of claim 1, wherein the nucleic acid encoding therapeutic agent is inserted into a different gene or locus from the nucleic acid encoding the transporter protein and is inserted in the hemagglutinin (HA), thymidine kinase (TK) or F14.5 gene or locus.

11. The recombinant vaccinia virus of claim 1, wherein the therapeutic agent is selected from among a cytokine, a chemokine, an immunomodulatory molecule, an antigen, an antibody or fragment thereof, an antisense RNA, a prodrug converting enzyme, an siRNA, an angiogenesis inhibitor, a toxin, an antitumor oligopeptide, a mitosis inhibitor protein, an antimitotic oligopeptide, an anti-cancer polypeptide antibiotic, and tissue factor.

12. The recombinant vaccina virus of claim 1, wherein the therapeutic agent is an antibody or fragment thereof that is a single chain antibody (scFv).

13. The recombinant vaccinia virus of claim 1, wherein the therapeutic agent is an anti-VEGF single chain antibody, a plasminogen K5 domain, a human tissue factor-αvβ3-integrin RGD fusion protein or an interleukin 24.

14. A combination, comprising:
a recombinant vaccinia virus of claim 1; and
one or both of
(i) a substrate transported into a cell by the transporter encoded by the virus; and
(ii) an anti-cancer compound.

15. The combination of claim 14, wherein the substrate is detectable.

16. The combination of claim 14, wherein the substrate emits an electromagnetic signal or induces such emission.

17. The combination of claim 14, wherein the substrate is radiolabeled.

18. The combination of claim 14, wherein the substrate is conjugated to a cytotoxic agent.

19. The combination of claim 18, wherein the conjugation is direct or via a linker.

20. The combination of claim 18, wherein the cytotoxic agent is a radiolabel, a cytotoxin or a cytotoxic drug.

21. The combination of claim 18, wherein the cytotoxic agent is selected from among double-chain ricin, ricin A chain, abrin, abrin A chain, saporin, modeccin, modeccin A chain, *Pseudomonas aeruginosa* exotoxin, *Cholera* toxin, *Shigella* toxin, *E. coli* heat labile toxin, *Diphtheria* toxin, doxorubicin, daunomycin, 5-fluorouracil, methotrexate, taxol, ricin A, colchicine, cytochalasins, monensin, ouabain, mitoxantrone, vindesine, vinblastine, vincristine and enterotoxin.

22. The combination of claim 14, wherein the substrate is conjugated to an anti-cancer agent.

23. The combination of claim 14, wherein the combination comprises the virus and an anti-cancer compound selected from among a cytokine, a chemokine, a growth factor, a photosensitizing agent, a toxin, an anti-cancer antibiotic, a chemotherapeutic compound, a radionuclide, an angiogenesis inhibitor, a signaling modulator, an anti-metabolite, an anti-cancer vaccine, an anti-cancer oligopeptide, a mitosis inhibitor protein, an antimitotic oligopeptide, an anti-cancer antibody, an immunotherapeutic agent, a bacterium and a combination of any of the preceding thereof.

24. The combination of claim 23, wherein the anti-cancer compound is selected from among cisplatin, carboplatin, gemcitabine, irinotecan, an anti-EGFR antibody and an anti-VEGF antibody.

25. The combination of claim 14, wherein the substrate and virus are formulated as a single composition or separately in two compositions.

26. The combination of claim 14, wherein the anti-cancer compound and virus are formulated as a single composition or separately in two compositions.

27. A kit, comprising the combination of claim 14; and optionally instructions for administration of the composition(s).

28. A pharmaceutical composition, comprising a recombinant vaccinia virus of claim 1 in a pharmaceutically acceptable carrier.

29. The pharmaceutical composition of claim 28 that is formulated for local or systemic administration.

30. A pharmaceutical composition, comprising a virus of claim 6.

31. A combination, comprising:
   a recombinant vaccinia virus of claim 1; and
   one or both of:
      (i) a chemotherapeutic agent; and
      (ii) an antiviral agent.

32. The combination of claim 31, wherein the chemotherapeutic agent is selected from among gemcitabine, irinotecan, doxorubicin and cisplatin.

33. The combination of claim 31, wherein the anti-viral agent is selected from among ST-246, cidofovir, alkoxyalkyl esters of cidofovir, gancyclovir, imatinib and acyclovir.

34. The combination of claim 31, wherein the chemotherapeutic agent and virus are formulated as a single composition or separately in two compositions.

35. The combination of claim 31, wherein the antiviral agent and virus are formulated as a single composition or separately in two compositions.

36. A kit, comprising the combination of claim 31; and optionally instructions for administration of the composition(s).

* * * * *

UNITED STATES PATENT AND TRADEMARK OFFICE
CERTIFICATE OF CORRECTION

PATENT NO. : 8,852,927 B2  
APPLICATION NO. : 12/660314  
DATED : October 7, 2014  
INVENTOR(S) : Szalay et al.

Page 1 of 2

It is certified that error appears in the above-identified patent and that said Letters Patent is hereby corrected as shown below:

IN THE TITLE PAGES:

In Item (56) References Cited, in U.S. PATENT DOCUMENTS, please insert the following reference: --2014/0087362    A1    3/2014    Szalay et al.    ................... 435/5--; and In Item (56) References Cited, in FOREIGN PATENT DOCUMENTS, at page 2, column II, line 17, please replace "WF" with —WO—.

IN THE SPECIFICATION:

At column 3, line 35, please replace "*Proteinaceous*" with —Proteinaceous—;

At column 15, line 36, please replace "elfornithine" with —eflornithine—;

At column 22, line 50, please replace "Carillo" with —Carrillo—;

At column 23, line 16, please replace "Atschul" with —Altschul—;

At column 23, line 18, please replace "Carillo" with —Carrillo—;

At column 45, line 14, please replace "PANC-1cells" with —PANC-1 cells—;

At column 45, lines 63-64, please replace "$^{123}$I-MIBG $^{131}$-MIBG" with —$^{123}$I-MIBG, $^{131}$I-MIBG—;

Signed and Sealed this  
Seventeenth Day of February, 2015

Michelle K. Lee  
*Deputy Director of the United States Patent and Trademark Office*

CERTIFICATE OF CORRECTION (continued)
U.S. Pat. No. 8,852,927 B2

At column 48, lines 25-26, please replace "*pseudomonas* A endotoxin" with —*Pseudomonas* exotoxin—;

At column 50, line 64, please replace "*pseudomonas* A endotoxin" with —*Pseudomonas* exotoxin—;

At column 51, line 29, please replace "MIP- 3α, MCP-1β" with —MIP- 3α, MIP-3β, MCP-1—;

At column 66, line 37, please replace "Glamolec, TNP-470" with —Glamolec, CI-994, TNP-470—; and At column 83, line 5, please replace "elfornithine" with —eflornithine—.

UNITED STATES PATENT AND TRADEMARK OFFICE
CERTIFICATE OF CORRECTION

| | |
|---|---|
| PATENT NO. | : 8,852,927 B2 |
| APPLICATION NO. | : 12/660314 |
| DATED | : October 7, 2014 |
| INVENTOR(S) | : Szalay et al. |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 180 days.

Signed and Sealed this
Twelfth Day of January, 2016

Michelle K. Lee
*Director of the United States Patent and Trademark Office*